United States Patent 6,562,958 (NUCLEIC ACID AND AMINO ACID SEQUENCES RELATING TO ACINETOBACTER BAUMANNII FOR DIAGNOSTICS AND THERAPEUTICS) - sequence listing, part 3

SEQ ID NO: 6464 - protein, 285 aa, Acinetobacter baumannii
RREAKMNRVIACIDSSPCINAIADAAAWVAKATGRELVLLQILDYYPASYHLGEISGVIGFESNAMLLKELAELEQKQSELALDYSNNLLRHISDLIKEKHGITCSKIQEKGDFLEQSFNLLHENDIVILGRVGERAAEKHKPIGSNVENFIRGANCTVLTIGENFKVPTRFIFAYEYSPTCQKMMRRIAQSDLLRTLQCHLVYVGDHPEILNEPEHYLKQAGLDVVTVYRYGDVAQNILEYQQEHGIQIIVLGAFSHSKIHQFFLGSIATTIFRNATVPLLVAK

SEQ ID NO: 6465 - protein, 575 aa, Acinetobacter baumannii
RTRARTMLNEAASAVLKTQPRRKTEYSLRSNVALAAVAIALTLAIIAPLMMLFETAFFDENQNFVGLENFYNYFASPALLSSIFNSVWVACAATVITVFLASIYAFALTNVNIKGKSFFKLVAFLPILAPSLLPSLALVYLFGKQGVFKPLLGDIQIYGPIGILISYCFWLFPAILMLMMVSFRSVDQRLIEASLSLGKNIWKTHYHVTLPAIRYGLISASLVAFIYVLTDFGIPKVIGGSFNMMALDVYKQIIGQQNMSMGAVISILLLLPAVFVFIFDRIQSKRHARFQAFQAKPYVSASNKKLEVVLSIFCGLVSGSILLIIFTAVLASFIQSWPYDLSLTLAHYSFEYVDGGGWAAYFNSVRMALFSTVFGTALIFMVALLTERFKAHPLIKNYVQALVLLPLAVPGLVLGIAYILFFNQQSNPLNVLYGTMTILVISTIVHYYTVPHLTLTNAIKQIPLQLDQAAQTLGTSKWKTFWKVYLPMCFPALCDVSVYVFVNAMTTVSAAIFLYSPDTSLAAVAVLNMDDAGDTVSAVAMSILILTTSCVVKLIHWLFTRKIMARSQQWRESAH

SEQ ID NO: 6466 - protein, 149 aa, Acinetobacter baumannii
IYNFFWVVAMQTSVHWLENVAFEAKSESGHSVVMDGSPEYGGENRGPRPMELILMGLGGCASFDIVTILKKSRQDVTNVVCQLKAERADAIPAVFTKIHLHFVVTGKAVKEKQVAKAVELSAEKYCSASKMLSDGGVEITHDFEIIEAA

SEQ ID NO: 6467 - protein, 508 aa, Acinetobacter baumannii
SYNLFIIKAFTTVAINWSKYYMSKNNGKQFLEGDLLGSQHMTEQEEEKLQRSLTNRHIQMIAIGGAIGTGLFMGSGKTLSVSGTSIVLTYLIIGFFFFFVMRAMGELLLANTNFKTFADFATAYLGPWAGFFLGWSYWCNWIITAIADVIVIGGYMQFWYPDLPVWIPAFTSLAILTILNFVAVRLFGELEFWFSLIKITAIILFILAGIYLIGTGFTSPNGVKASMSHLFETESMFPYGVTGFLAGFQIAIFAFVGIELVGTTAAETKDPHTSLPKAINSIPLRILLFYVGALVCIIAVTSWAKVSPEKSPFVEMFTLVGLPIAAGLINFVVATSALSSANSGIFATSRMLYGLALDNDAPKSFSKLSKRKVPIRGLVFSMACVTVGTSILFIVPNVMTAFTIISALTSILCIFTFMLIVLSYIYYRKKSPELHIQSKYKMPGGLFMAWMTMLFLVFTIVILALDHDTLIALECSPIWFIGLFIAYKYKKKKMLQLDILKAQKVDYI

SEQ ID NO: 6468 - protein, 144 aa, Acinetobacter baumannii
NNNFYNTNKKDGPFTMDQKILEHLPPIHQHLGGHNIHWNDQNTELTIHYTALESFTNPRGTVEGGMICAMLDDVMGLFAYLANDRKPATTINLTMDFLRPCAVGEIITKCRFIKQGKTVLNLESEAWQNNKMIARSTANFLVLD

SEQ ID NO: 6469 - protein, 411 aa, Acinetobacter baumannii
KNNFVRMIRMSVTLGTPLQSSAFKVLLLGSGELGKEVVISLQRLGVEVHAADRYDHAPAMQVAHFSYVLNMADPAQLKQLIEKVKPNLIVPEIEAIATEVLLEIEANKTATVIPSAKAVNLTMNREGIRRLAAEELGLPTSAYRFADSLESFRAACDDIGYPNFVKPVMSSSGKGQSRVKSFDEVDAAWEYAMQGGRVNQGTVIIESQIDFDFEITLLTVRAKNPETGEIETHYCDPIGHRQDAGDYVESWQPQPMTPAALEEAKRVANKVTTALGGCGIFGVELFIKGDKVWFSEVSPRPHDTGLVTLASQFQSEFELHARAILGLPVNTARHSVAASAVIYAGVDANNLSYSNLNVALAHPDTDLRLFGKPEGFKRRRMGVATARAENTDLARTLAKETADQVSVQTNS

SEQ ID NO: 6470 - protein, 66 aa, Acinetobacter baumannii
NVNLLLCIYEYPYMIHFKYCAESFCLVTRFCLEAGFLISKPHLLRTLYESTGRTDYGIGSPAKYRL

SEQ ID NO: 6471 - protein, 222 aa, Acinetobacter baumannii
GFFLNHGRNLWKIVCRDKHMAFNIFIAFWSVSILFIITPGADWAYAISAGIKGKVVVPAVAGMLFGHFITILLVAAGVGLLVANNPTALMILTVAGSAYLLWMGINLLLTPPTPNKSGSEKAQSWLRWATKGVYVSGLNPKVFLLFLALLPQFIDTTASWSVTTQILAFGVVHIISCAIIYLMVGYGSEAILKTRPQAAQLVGRFSGGLMVVIATCLLIGQI

SEQ ID NO: 6472 - protein, 190 aa, Acinetobacter baumannii
IKFYMNLLLIVVLGAIVEIAVWIGVAQFISGWYVFFWFIIAFFIGLTLIRNSTAGIMPQLQQMQMTGQLGNDPTVTKKLAYAFAGFLLMLPGLVSDVLALLILIPGVQTAFRNIAMRTLAKRQQAMMNKMMGGMGGAGAGQNPFADLMRQMQDMQNQQGGGSQYHDSSVIDGEAREVTPDHKKIEHKNKD

SEQ ID NO: 6473 - protein, 283 aa, Acinetobacter baumannii
ELIYLANSILFLKLKMRLKHIILTTCLFSSTLAIAELPQDSRRPGGIAVIPLTSDITQVTFQHKPVLISQEGQQRYAVFGIPLSTPLGSVQLDTNKAPIQIEVKSYPYAEQRLKVTNQDYVNPNQSQLDRYAQEAKEQNDVYSSFTQSSWQALPKFIRPTSGKFTNSFGRKRFFNGEERAPHSGLDIPAPIGQKVVAPADGVVVQTGHYFFNGQTVLIDHGQGLISMFCHLSEIKVEKGQHIRQGETLGLVGKTGRVTGPHLHWGMSLNNARVDPQLFLNTTH

SEQ ID NO: 6474 - protein, 516 aa, Acinetobacter baumannii
IRNFIGSTHMTAQMKTNASAKKAVNSPHHIYDTFIVGAGISGIAAAIRLDQVGYTNYKIIEKAGRVGGTWRENTYPGCGCDVPSALYSYSFAPSAKWSHLFARQPEILSYLEDVSNEFNITSKIEFNNELLNAAWDESRHLWVLDTTTGQYLSRTVIFATGPITEAQIPRLEGLDTFTGEMFHSAKWNHDYDLTGKRIAVIGTGASAIQFVPQIQPKAKELFVFQRTAPWVLPKPDTDLGELSKSIIAKYPAIQASWRKSVALTLNAINFGLRNPLALKPVNILGKQLLKLQIADPELRKNVTPNFDIGCKRILFANNYYPALQAPNTTLIPHGLVKVEGNTVIAANGERHEVDVIIWGTGFEVSHPPIGKRVFNEKGQRLNDLWKNSSPEAYLGTNIENVPNAFLVLGPNVLVYDSFIGLAEAQLDYIVDGLLKIKNKGISKLNVKADVIKKHNDLVQKHLQTTVFNSGGCKSYYLDANGRNFAAWPWSLKKLKQRLKKLDLKDYEVTYQMSKTH

SEQ ID NO: 6475 - protein, 105 aa, Acinetobacter baumannii
RNSYSESATDGYDEIGINIYYDSADKTIALEFYEPAQVAFNGIEIFNISASEAYKLMASLDKDIAIDGDGLTSFKFGIGFYEPNYEEEPFLPVEAIIIFIEGYYD

SEQ ID NO: 6476 - protein, 249 aa, Acinetobacter baumannii
RLTYRLENVFNISISKEHNDMNIWSILCLIWTLAAYVVAKRIYQKHPKLWLSPAISVPVLTIILMTIFGISYQTYSEDTQWIVNLLGPATVAFAIPIYRYRETIRKNLGVLTIAIIVGMSVGVMTAYKMAQWFHFSPEVTNSLMARSISTPFAMILAEDIHGSAALVSLFTVITGLVGMICGDAILAITKIRSNVANGAAFGNAAHGFGTVRAQQRNSEEGVIASLTMVIAGILMVLIGPFAIHLWLLL

SEQ ID NO: 6477 - protein, 105 aa, Acinetobacter baumannii
STYYLHTNLTGLNYLLSKAIYETKNTYSHAYQTVINYKNMAVNKVYRQLRTLNIDNSFPKIKLISLLKCINILNQTFNKRLFLSRFIDIRNFLINFEKEYKKQKD

SEQ ID NO: 6478 - protein, 236 aa, Acinetobacter baumannii
VHYYTGNFCSARCKSRRYLMSVQKRSREDIAKLIANDIPEGSYVNLGIGLPTNVAKFLPKDKEIFLHSENGVLAFGPPPQPGEEDQDLVNAGKELVTLLDGGCFMHHGDSFDIMRGGHLDICVIGAFQVAVNGDLANWHTGKADDVPAVGGAMDLAVGAKTIYVYMEHVTKKGEPKIVKELSYPITGEQCVNRIYTDLCIIELKDQKAYVKEMVDGLTFDELQAVTDCELIDARVA

SEQ ID NO: 6479 - protein, 903 aa, Acinetobacter baumannii
VLNYLKILRVMMSSLKILITKLSTAARTALEKSANACVLQQNYEIEIEHLFLELLNQSLENDLKILLKKYKISADALADDLKETISQLPKGNTRTPIFAKSIVRLFEQAWLLASAEQNPVIRSGHLLVALLTAPDLYQIATRASSLFDLFPIDSMKHKFLEICEKSVEQQEESKTSSQADELEQAVTPTAKTQKTPALDQYTINLTEKAKNGGIDPVIGREYEIRLMLDILMRRRQNNPILTGEPGVGKTAVVEGLALKIAQGLVPEALKNVHLHVLDMGLLQAGASVKGEFENRLKQVIQEVQSSAHPIILFIDEAHTLIGAGGQAGQNDAANLLKPALARGELRTIAATTWAEYKQYFEKDAALSRRFQVVKVEEPTEEVAVDMLRAMIPVMQKHFNLQIDDEAIVTAVHASHRYISGRQLPDKAVSVLDTAAARVALTQNAQPVKLDQLKAQEHNLKLEQQILENEHRQIPIHHERLENLKSQLESLQSEIQETQEQWQKELELVRKIQELEAQSHSNESEAYDQINLIRKDLADIQGQQPLVFERVNSQIINEIISDWTGIPVGKMVNDEIKQILTLEDKLGERVMGQDYALTQLVQGIKTSKAKLEDPNKPQGVFLLVGPSGVGKTETALALANELYGGEQHLITINMSEYQEAHTVSSLKGAPPGYVGYGQGGVLTEAVRRNPYSVVLLDEIEKAHSDVQELFYQVFDKGTLEDGEGRVIDFKNTTILLTSNTGSSAIMQACLNQPVEEWPTAEDLIEHLKPSLYKQFKPAFLGRMRVVPYFPLHDDLLVRIIKHKLGKITARIEKQYGTEVQYSDDLVELLLSRCTEVDSGARNVDNILNSTVLPALATEILVALADQKLPKLIMIDAKDDEIQYLLDPVAKPAKKRTSKKLKSEV

SEQ ID NO: 6480 - protein, 404 aa, Acinetobacter baumannii
TQNYLNKHCSERNSTMKKSYLQAALSTALMAVIYPSYAGISFGNTDDEYGKLTVSGYVRANYQDKHYGESASDQKIRFDAAQLKLDYERGPLFGHAEYRCYQYDRLCDFSTLIDGYVGYKLNKTDQVVAGVQPIPFGPGRFWGNSLYGSMSTTAGLEDVHNLGLNYHFELPTATKFDVGYFAVDGGNYTGSTQDSGRYTANYVSSDDPNKTDLQEKNMWVGRVTQNINLGINGLTTQLGGSYWTSDIENKATSSDGRRHAWALFGKANYGNLNVTLTGGKNDVTNQDQLNPNQSLMGSYDTEYYVANKGTFYTADVGYSFKNVKQIGNITPYFMYSHYDKDQDSMKDSIRNIIGVSIDHKQLSLVAEYIMSKNDPFIGGTQDSLAKGDDNQWNKLLNLTLFYYF

SEQ ID NO: 6481 - protein, 352 aa, Acinetobacter baumannii
EGNYRRVCLPHPFFFRCGVNMNQVELIQTLPKAELHVHIEGTFEPELMFAIAQRNQIQIPYKSVEEVKQAYNFHNLQSFLDIYYAGANVLVHEQDFYDLAWAYFEKCAEDRVVHTEMFFDPQTHTDRGIAFATVINGLKRACADAKDKFGISSQLIMCFLRHLSEEAAFETLEQALPFKQDIIAVGLDSSEVGHPPAKFERVFAKARQEGFLIVAHAGEEGPPEYVWEALDLLKVNRIDHGVRSEEDEQLMARLINEKMPLTVCPLSNLKLCVVKDMKDHNIRRLLQKGVHVTVNSDDPSYFGGYMNDNFFAIQQALDLTNDELKQLAINSFEASFISDEEKQKWISEIQKI

SEQ ID NO: 6482 - protein, 63 aa, Acinetobacter baumannii
LRDYLLNGGLWFRGYFENQTTGSPISWPFFGWLDGRYRNVLIDWANLKVIQRKVTGLDFRSVT

SEQ ID NO: 6483 - protein, 462 aa, Acinetobacter baumannii
RRLLYSAHSILSNSSSQLKRGLKNRHIQLIAMGGAVGTGLFLGSAQVIQSAGPSIILGYAIVGLVAFLIMRQMGEMIVEEPVVGSFSYFAQKYWGRFPGFLSGWNYWVVYILVAMTELTAVAKYVHYWWPHIPAWVSVLFFFGLVTCLNLGNVKFYGESEFWLAIIKVAAVISMIVFGLYLLLTAGSDSIASFSNLWQHGGFFPHGFSGLFYMLAFLMFAFGGIELIGMTAAEAENPEKSIPQAINQVIFRILVFYVASLAIIMSLIPWNQLDLGGLDKSPFVMIFSQLGIGWAAHLLNFIILTAALSVYNSGMYANSRMLYGLAVQSNAPKVFAKVSKQGVPTSAVIFSSILIFGCVLLNYFIPEEALSYLMYMAVAALVLNWAIISFTHLKFKRSMKLENKVAKFPALFSPLSNYIVLTFIGMILYIMWTQGFEKSVILIPIWIAFMFGLYTILSWKKSL

SEQ ID NO: 6484 - protein, 153 aa, Acinetobacter baumannii
IKGYIMNNKKIVIDYLDKNNELSKELIWGEMCKTDQYFVRSIPFFAPNLAFNDLIQVEMDDKTLYFDDLIKPSNNSTLRIVFLYNDIKYIEKILTTLESHLCGWEGFEGGLYYAINIPKKVDYALIKKCLDDKSDFLDYEESCLSDKHSSDLF

SEQ ID NO: 6485 - protein, 288 aa, Acinetobacter baumannii
TENFMKSFKNKVAAVTGAGSGIGQALAIALAKQGCHLALSDISEAGLAKTVELLAPYSVKVTTQKVDVAKRDEVATWAKAVVDEHGQVNLIFNNAGVAIGSTAEGVSYEDLEWLIGINFWGVVYGTKEFLPYLKQSGDGHIINISSMFGLTAQPTQSAYNASKFAVRGFTESLRQELDMQNAGVSATCVHPGGIRTNIAKAARMNNSVQSLGMDPLKSQDAFDKLLRTPADDAAQQILEAVRKDRRRLLIGADAKAVDVIQRILPQGYQKIFAAATAWQTRLLNKSAK

SEQ ID NO: 6486 - protein, 89 aa, Acinetobacter baumannii
KLFYHNTPTTLKFLLKLHIAALLVLTMHQIQQVHIRGEYLDKPEYLNIMRPYYVHLITSLPVFVLAEVHELLLIAQWIGKFYPDPEGWL

SEQ ID NO: 6487 - protein, 104 aa, Acinetobacter baumannii
KGILIMETLHFEFVATEPPVKKALVGCVGSGDLEILMEPGETGKASIHVVTSVDGSAARWHNLFERIFTAQIPPAVNIDIHDFGATPGVVRLRLEQALEEIAHD

SEQ ID NO: 6488 - protein, 509 aa, Acinetobacter baumannii
AFSYSFIKRLKNKVLQLVMLINFLRNFVMKIISKPQLLKDVEYKPSQSLQVGKEWSWLNPKHAQFDATTVNGTSVDNPANYYESSLSNWHTFDSLNTDIECDVVVIGGGLLGSSTALHLAEQGVDTVLLEKNRIGSAASGRNGGQLTPGLARWEAQEMADRLSYEDAKKLWHFTSTEAMQLIDNISEKYQLNFDRKYGHITAAVHEGHLVGLTQGADARKYLGEDHTRIVGKHELMDYIKSDYYTGGLIDELGGQIHPLALNRGLIYGFCQNGGSVYEQTEVISIEEKADGIYVHTVNAVVKAKKSVVLAVHHASFKLLSEQNNTTIPFYTYVATTAPLELDTKELLPFGHPVYDTQFQIDYYRPVFNNRLLFGGQGTGTCWGPEKTLNYLEHRIHTVFPQIKNLEMDFVWSGTTDLTVNGAVDSRKFGNKFPIYAVHGWSGHGVAQTVRIGKAIANDFVGQSNDFEMLSKIDHQNIIFGRTLAPVVIPLAKSMYGLGAMINPGKMVSF

SEQ ID NO: 6489 - protein, 62 aa, Acinetobacter baumannii
YQPYSLKKKYTTLKSRKEIHHKKSYWFCAYRIDGTNDLNMCFRWLAGNKEFTPQSYSLFPHM

SEQ ID NO: 6490 - protein, 264 aa, Acinetobacter baumannii
VMDYQNIIAEEKNGVGYLTFNRPKALNSFNVDMHREVAEVLNLWTKNPDVRCVVISGEGRGFCAGQDLGDRVVDPNAEAPDLGYSIETYYNPLIKTIVNMPKPVICAVNGVAAGAGANIALACDLVIAAKSANFVQAFCRLGLVPDSAGTWFLPRAVGHARAMGLALLGDKLPAETAKEWGMIWDVVEDAELKTKVTELAERLAKQPTFGLSLIKKAIHQSSNNTFDEQMLLERDLQRIAGRSEDYREGVQAFMNKREPNFKGR

SEQ ID NO: 6491 - protein, 206 aa, Acinetobacter baumannii
IMSYKRSSLMQERMEQNRKSILSSARKIISEGGFKDAQIQTIAEQAGVSSGLVYRYFDNKSQVLIEVLSDAINTELLVIESITESDLSAKQKLHKAVATFVKRALNSPQLAYSLMFEPVDSTVEHERFRVKQLIKQSIKKILADGNASGEFVLDDLNTAALCVVGAMTYVVVEPLDPAQNTKFDHAYKDYFSKQIADFCVDAVQKK

SEQ ID NO: 6492 - protein, 334 aa, Acinetobacter baumannii
EAGYRTVSGKNMKTKITELFEIEHPIIQGGMHYVGFAELAAAVSNAGGLGIITGLTQRTPENLAKEIARCREMTDKPFGVNLTFLPTVNTPDYPGFVEAIIKGGVKIVETAGRNPEQVMPYLKAAGIKVIHKCTSVRHSLKAQQIGCDAVSVDGFECGGHPGEDDVPNMILLPLAADALEIPFVASGGMADGRSLAAALAMGADGINMGTRFIATQEAPVHANVKQAILNATERDTRLIMRALRNTERVMNNAAVEKIVAKEKALGDNIKFEDIMEEVAGVYPKVMIDGDVNAGAWSCGLVASLIHDIPTCDELVSRIVKEAEDIIRGRLSGLL

SEQ ID NO: 6493 - protein, 193 aa, Acinetobacter baumannii
FQLYGNVMSKKEDIINTALELFNQIGYNATGVDKIIAESNVAKMTFYKYFPSKESLIMECLHHRNINIQNSIYEKLSLHPDVSPIEKIHLIFNWYIDWVNSENFNGCLFKKAFIEVCKQYTSIREPFQEYTNWFINLLNSLLVELDIKDPTPLTHIIISIIDGIIIDGTIDKDLIDPSKKWQYIEYLIKTENP

SEQ ID NO: 6494 - protein, 64 aa, Acinetobacter baumannii
KTSLNSHLRVAFLRLKESEMNIEQYLDDLIEREGGYVNNPADRGGQLNTELLKQYHVQTAIKAI

SEQ ID NO: 6495 - protein, 237 aa, Acinetobacter baumannii
LKLYICYKLAGAIIMALKDRLKDSRIKAKKTQAEVAEAVKMSQPAYQALESGKNLKSAFLPLIAQFLGVDAYWLTTGNSEDSFRESDVFSPTVVNNDAADQYVWIEVVEASFSCGTGESIEFHFDAINGKIPFPASFFKEKRVAQECMRIIKAKGDSMTDYIKDGDLVGIDISQTEVIDGEIYAVYFAGEGMIKQIFKEADGSLILHSLNEKFRDRRVTEENGKNFKVMGRQFWRAG

SEQ ID NO: 6496 - protein, 156 aa, Acinetobacter baumannii
SHPYLIRETFHMKKYLLLILFSFYSVHSFASDKLHGSVWKTIDDATNQPRALVKFSQDKNGVLSANIEKILVPSEANKCTMCEGTYKNKSLIGLTIVKNLKNVGQNKYDKGSILDPQSDKTYRFSVTVSPDGEKLTARGYIGISAIGRNQTWYRVK

SEQ ID NO: 6497 - protein, 319 aa, Acinetobacter baumannii
KLTYYKSKGIFKTGRNVNLKNLEAFYWVVTLNSFNKAATKLQTTQPAVSQKITSLENELGFKVLDRSLRQFKLTHKGMTLFKYAEKFMRLETDLVAELTENQHLTGTIRLGVSETIVYTWLVEYIEKVQQEFPKVSVEIVVDLTPNLQEGVRTGDLDMAFLLGPTLAFECIEQSLCNFELSFLAAPSFKGGIGQMSFKALMSHTILTYPKITYPYKELKAKMKEKGIDEPLSITSYSLATLLRLAEQGLGIAVVPTLTALKEITDGRLEILNTPIRLKTFHFTSIYIHGNDVALKEKLTEVAVQVSESAMKRLNEQIKK

SEQ ID NO: 6498 - protein, 392 aa, Acinetobacter baumannii
TQQYLIFMTSSLKKIALLKQGLGKNSPFAAGRQGTLEAIEHLGYVQIDTISVVERAHHHILWSRVPDYDLSHLNSLVRERQIFEYWYHAASYLPMKDYRYALPAMMSVRKGESRYFNRGDQHLMNEILARVRAEGKIRLRDIDKKNKESLGNWWNTGPGRRAFEQLYMQGDLMICERNGMEKVYDLTERCLPENIDLSLPTLYEYAQYLFNNTLRAHGAFTWKQLVHLKKNDLKETMRVVLKEQIDAGVVSAIKLADGQTLYVDVTAIEQQLDTDFGLKILSPFDNSLIHRDRLTSLFEFDYRIECYVPAAKRVFGYFCLPILYQNELVGRIDCKAHRTVKELEVINLHLEKTVKDKEHFFFELDQELKRFAAFNQCSTVNDKVVKLIRSKL

SEQ ID NO: 6499 - protein, 369 aa, Acinetobacter baumannii
NFKYRVHMKFNLKRISGFLIITSTLILTACSGEGSDQNTNDQAESNLEKEDTIYKVYYQPSDISSGIYSDFFEITPYSIKNNEIFFAKSHNQPLETELLTEQKVLNKGTLQTNIVKRLTPSSWSYERIPNLKQNLKFEIVKLDGENIFDRVLPGYKEYNNLETSLNNQLDKNLIDFYQNYKNVRFPKNSYCYRLKESQWNQSYISYISSFNTNPSFSERKKSIIERYNNLGLDKKYFRLINSQWYGYNLVVLENLENGDVQSTLGNNNDQSATIDFVSSSLWNADKSLAFEKSHLYSTDDNPLNSVHSLIALKQKLKIADLEKGCFAFNTQAAQAIQKLNLVNWKPGDSSVIAPFFGLRTFIDNRSQKQ

SEQ ID NO: 6500 - protein, 94 aa, Acinetobacter baumannii
TLKYELDSVFGMETCEMKNQRDAVLGYADEQHAYYIRLIENDAVLGESYGIFCENPESEAAESIMTTLFLKKSFWLNGSEFTDIVKGLHPLTHS

SEQ ID NO: 6501 - protein, 754 aa, Acinetobacter baumannii
TPKYVKLCIVNIYMFWSIEFMNTSLRLNHYWITCADGLETLLQEEIEQLGTKVTERKAGRLIIEGTLEHAYRICMWSRLASRVLLPIHTYELERTHDARDVAEELYEGAISFDWSLIFAPQSTFAIRLHAEREIKVNTQFATLRVKDGVVDSFMEAVGRRPSIDTKQPEITLYVLAGKTEHTYCLDLSGDSLHKRGYRRFMTDAPIKENLAAAILQKAKLQERNPEIVLDPMCGSGTFIIEALMILTDRAPGLVRRFGFNGWHGHDRELWLSLKAEAAERHEKALEQPLPKFYAYDADWEAVKATRENIIAAGFEKLLGDIQIEERTLADWPDFGAENKTAFIVTNPPYGERLGDKASNRSLYLGLSALLQKNFPNQYAAIIAAQIEQADVLAFEAPETLRLMNGKLPIYVRFGTVKPEKVTQPFLANWQAQPVEMEEAQDFANRLQKNMTALKKWATKENIYCLRLYDADLPDFNLAVDLYGDRLHVQEYAPPKKIDPEKAKKRFNLALAAIRAVTGLNRDAIFIKTRARQTGTNQYTKQSTANKRFIVQEGKAKILVNLTDYLDTGLFLDHRQMRLRIAQEARGKHFLNLYSYTSTASLHAALGGAASTTSVDLSNTYLSWSKENFVLNGLTVDHADEQHMFFASDCFEWLKEGHEQYDLIFIDPPTFSNSKKFHGTFDVQRDHVSLIKRAMNRLTSEGTLYFSNNYRGFEMDEEIEALYDVEEITSETIGPDFKRNQKIHRAWKIQHPGLS

SEQ ID NO: 6502 - protein, 117 aa, Acinetobacter baumannii
ITKYSGMKMGALNGIRVLDLSRVLAGPWCGQILADLGAEVIKIERPKVGDDTRSWGPPWMKDDSGQDTQEAAYYQSTNRNKLSVAIDIASSEGQELIKALIQDTDVVIENYKAGSLK

SEQ ID NO: 6503 - protein, 433 aa, Acinetobacter baumannii
GYWYMTTTLKKVVAASMVGSVAEWYEFFLYGTASALVFGELFFQQTGNAIDGILAAFALYAVGFLARPLGGLVFGHYGDKIGRKKLLQISLIIVGITTFLMGCIPTFHQIGYWAPTLLVILRLIQGFAFGGEWGGAVILVSEHSPDDRRGYWASWPQTGVPLGNLVATLVLLLLSKNLSPEQFLDWGWRCAFWFSAVVVLIGLWIRKNVDDAEVFKEAQAKQQLLEKQQLGIIEVLKYHKKSVIAGIGARFAENILYYMVVTFSISYLKLVVHKDTSQILLLMFGAHLIHFFIIPFMGHLSDIFGRKPIYLIGAVLTAFWGFVGFPLMDTGNDWLIMLAIVLGLFIESMTYSPYSALMTELFPTHIRYTALSFCYQVAPIMAGSLAPLIALTLLKEFNSSIPISLYLVAASLISIVSILLVKETKGRSLAFKD

SEQ ID NO: 6504 - protein, 225 aa, Acinetobacter baumannii
TDWYLYNIVIRSQGYELMKFLKFLTFSTILTLSAHTYATVGGGQKIEVLGYQQKEKKLYVLRHYEDGRGRLPQLYYYLLNSKSPDKLIEVKSLYINPKTHKIDYDQDSTAFNKALNKIKKNLTPLIVSNSKTVKIQTLKTHQNQVSFWFDPSGKITQYKTEYVVKSPSLQSKTHVAVHYSKAIKISQNYSVPKQNKRLVVVKYLGVPEETGYDIEDPVLLLPIKK

SEQ ID NO: 6505 - protein, 536 aa, Acinetobacter baumannii
LFRYWSFKMSKNNGRQFINGQRVAVNAPALESIAAKDYQPTGYVFSQATLEEVDQAAQAAHNAFLVYSQTTQEQRASFLEEIACQIEALGANLQEVASLETGLPLARLQGETGRVTGQLRLFAELLRRGDFYGARIDVALPERKPLPRVDLRQYKVGVGPVAVFGASNFPLAFSTAGGDTVAALAAGCPVVFKAHSGHMATAELVAEAIEKAIEVCGMPKGTFNMIFGGRIGANLVEHPLIQAAGFTGSLEGGMALYNLAQSRPQPIPFFAEMSSVNPVVVLPEALHSRGEQIAQDTVASFNMGCGQFCTKPGLILGVKGPEFDRFITALVENMQKAVPQVMLNEGTLKSYRTGIDALINEVGFEVIASGQEPELVSQAKAHLFKADQSVLLSGNPKLQHEVFGPMSIVIAVEDEATLLKGIEALGGQLTATIIGDENELSKAGELLDLLTRKAGRVLFNGFPTGVEVSDAMVHGGPFPATSDARGTSVGTGAIERFLRPVCFQNTPQVLLPDALKDSNPLQITRLVNGQLTQAKI

SEQ ID NO: 6506 - protein, 150 aa, Acinetobacter baumannii
NQDLKLTYNICEKRMMQPTHTHSTLQYIHISVPEILLSNIEIKNSWQDYNQEWSYRLDPPHASHPFQRDLYIIKSKNIETEDIKKLLDNVVKNNKNKDDLKNIVEAETVIKEILDLSNYIPIENWLNDTGNRSIVESMIDKNKVKLLDII

SEQ ID NO: 6507 - protein, 408 aa, Acinetobacter baumannii
MKHLIKFVSTETQLLGNCLMNSSLSLLHPYPFEKLNQLFKDITPANLPLIPLSIGEPKHPAPEFVKQAIIDNFNHLSTYPNSKGLPELRQSIADWLTKRFKLNSISAENHILPVSGTREGIFSFVQALINREDAPYVVMPNPFYQIYEGAALLAGAKPYFINCTEENGYLGDFDAVPAEVWEKTALLFVCTPGNPTGTVLSKEQFKKLIALSDQYNFVIASDECYSELWFDQAPTGLLEVCAELGRDDYKNCIVFHSLSKRSNLPGMRSGFVAGDAALLKPYLQYRTYHGAAMPVQHQLASIAAWNDESHVEENRKQYRAKFDLFQSELGHLLPLQKPDAGFYYWLKVNNDETFAKMLMEKAHIKVLPGRYLSRDTEQGNPGANHVRMALVADLAQCEEVVKRLKAIL

SEQ ID NO: 6508 - protein, 185 aa, Acinetobacter baumannii
VSLHMPLIIGIDPGSRLTGYGIIEKDGSKLRFVDAGTIRTETQEMPERLKRIFAGVERIVKFHGPTEAAVEQVFMAQNPDSALKLGQARGAAIAALVNLDLQVAEYTARQIKQSVVGYGAADKEQVQMMVMRLLNLTIKPQADAADALAAAICHAHASGSMSKLTVLNALGGMARGRSRSSSRRR

SEQ ID NO: 6509 - protein, 166 aa, Acinetobacter baumannii
RKIQMNGPLLSLDRTDLKILDILQTDGRISNSRLAELVNLSPTAVMARVQKLTKDEFILGYEAKLNPVKLNANFLVFVEVLLDKTTPNVLDEFIDAVVHYPEIVECHMVSGGFDFLIKLRSGSMEEFRRIAGQVLWQLPGVKETRSYPVMQVVKDSSKIKIKTKNK

SEQ ID NO: 6510 - protein, 304 aa, Acinetobacter baumannii
AGVHLESRSKIMNDSTFNAHEYFQKIYERPVILEAKQLSQVFKHGQTERTVLNKLDLKIHKREFICVIGPSGCGKSTLSRVIAGLDPYHSGEVLVDGECITGPCPERGMVFQGYTLFPWKTVKENVMFGPQMRGASQMTAEAQAREWINIIGLEKYENQYPYQLSGGMKQRVAIARALVNQPKILLMDEPFGALDPHTRQKMQKHLMDLWQNIDITIIFVTHDMDEAILLADRIVALKANPGEIKEIIEVNLPRPRSLDLMSTPEFKQLRTRVDYLVHAEEDELDPALQDLPKIPRMTQVSTEK

SEQ ID NO: 6511 - protein, 438 aa, Acinetobacter baumannii
QASQGHGLYGTTMALIVQKYGGTSMGTPERILNVARRVKRWHDHGHKVVVVVSAMSGETNRLLALAKAITETPDPRELDQMVSTGEQVTISMLAMALNSIGVEAKSYTGRQVGIKTDSAFTKARIESIDTDVMTNDLDAGRVIVVAGFQGFDANGNTTTLGRGGSDTSGVAIAAALKADECQIYTDVDGVYTTDPRVAPKAKKIDRISFEEMLEMASLGSKVLQIRSVEFAGKYQVPLRVLSSFDNDDDGAFDDEFKENVGTLITTEAEDTMEQPIIAGIAFNRDEAKLTILGVPDEPGIASKILSPVSDANIEVDMIVQNVEEDGTTDFTFTVNRVDLAKAEKILNETAKNIGAREVSTRDDIVKVSIVGVGMRSHAGVASKMFTALADEGINILMISTSEIKVSVIIDEKYLELAVRCLHTAFGLDREHGESSARA

SEQ ID NO: 6512 - protein, 478 aa, Acinetobacter baumannii
LISHKRRMKMPVVVKKRLLDLLQDNQQNYYELFVFFLDPDVSSFEKEKKARDFLVKEIDKLEMKEIDFPSDINLIKAWCENDNKKNCQEFQAYLNRRQSGQDREYFKNVAQAFEFLIKVSPTKKVDGAWLYSSVHYWNDPIFHELIITYLEELGLGEPKANHVCIYDDLLRSLGLDSFDLLLEDEYYHQAVVQLALGYAPPEFIPEIVGFNLGYEQLPLHLLISNYELAELGIDSKYFNLHITIDNIDNGHAYKAIKVIEDIYNKYRDKELFLTKLKRGFALNNHGVSSSNIIKNLNTEDFVHRIFKRKALVGQLIHNETRQFGCKTINQWLSNPDDIAGLITHLTDHKWIKFNTDPEQSVFWRMINEENGKMFGVFNPVERQIIHDWIAGSDHSSNFLAYSRELKNSQRIQDYLFSYISDGELDALQERVQQSSDLAIKICKLTPFLAPDSHHKSIGLWSTRKYVELLFPYLGTFKN

SEQ ID NO: 6513 - protein, 319 aa, Acinetobacter baumannii
YFNQFSVNQGKLVTQWNINAVVQGLQQARHDWRQQQHRTKEFGGRELPSKEALKTILDDLCGILFPMRLGPADLRQETEDSYIAYTLNRVLTALHAQVQLALNYEAKRHLSHSSPVQQPQELAQTIVQDFANTLPSIRRLLDGDVRAAYEGDPAAHSVDEVLLCYPGIFAIIYHRIAHQLYAQVPLLSRIISELAHSATGIDIHPGAQIGKGFFIDHGTGVVIGETCVIGERVRIYQAVTLGAKRFETNDDGGLKKDYIRHPIVEDDVVIYAGATILGRITIGRGSIIGGNVWLTHSVAAGSQILQSPNESYQKNHIAG

SEQ ID NO: 6514 - protein, 112 aa, Acinetobacter baumannii
IRNHRLRMKLQPTISKTIFYSFLFAIGGSPTLAMLIIYGQNYNPDFFMTAFMSLSVLIACVLIPVVLIQNSYLLWKRKNPNLEEKVKTLSHVYLGLNIICLIFWIYLMTLSN

SEQ ID NO: 6515 - protein, 331 aa, Acinetobacter baumannii
ENDQACCFQISHPKGKCKDTSMKTVKILDSHTGGEPTRLVLEGFPDLGTGDMESRRKILSEQYDHFRRATMLEPRGNDVLVGALLCKPVNPKASAGVIFFNNTGYLGMCGHGTIGLVASLAHLGKIQVGTHLIETPVGDVEATLHEDHSVSVRNVPAYRYKKAVEVDVEKYGKVTGDIAWGGNWFFLINDHGQRVASDNLDQLTEYAWTVRQALTAQGITGKDGQEIDHIELFASDTEADSKNFVLCPGKAYDRSPCGTGTSAKIACLAADGKLEPGKLWKQASIIGSQFIASYEQAGEYVIPTIRGEAYMSAEATLFMDENDPFAWGIQL

SEQ ID NO: 6516 - protein, 415 aa, Acinetobacter baumannii
GMDHMSIVKIENVRVLDPIQKTDSVQTVYIQDGKLIAPVDQVEQTIDGQGKWLMPTMVDLCARLREPGQQQHGTLKSEGKAARANGILHVITPPDSKPIVQDNGALIHGLIEKAWHDGGIHMHIIGAQTQGLNGKQPANMAGLKKGGCTAVSNANAAFENDDVVVRTLEYAAGLGLTVVFYAEEPQLAKDGCAHEGFIASRQGLPMIPAIAETVAIAKYLLMIEATGVKAHFGLLSCGASVELIRAAKAKGLPVTADVAMHQLHLTEQLIDGFNSLAHVRPPLRSEQDKELLRQGLKQGVIDAICTHHEPLSSSAKMAPFAETQPGITAFDTYVALGIQLINEGLFEPLEWVTKVTSAPAQVANMTARWQAEAGWVLVDPELSWTVSKDTILSQGKNTPLLGQKLTGKVLQTFAV

SEQ ID NO: 6517 - protein, 366 aa, Acinetobacter baumannii
LNCHIKLLKYDHQIIAFDGLQMKQYIQQTIKLGTASVLGVVVAIQMGCSSATSKQSEEITVYTAVEADQLKQYQEELHKAYPELKVKWVRDSTGVITAKLLAEQKNPQADVVFGVALTSLLVMEKKDMLEPFKPEGIQNLKPEFVSQKPVPTWTGMDAWESAICVNKVELEKRKLPIPKTWKDLTNPIYKNLIAMPNPASSGTGYLDVTAWIQIWGEKQAWDYMQALDKNISQYPHSGSKPCKMAAQGEIPIGVSFGYPAFKLKAEGAPLEVVYPTEGLGWEMEASAIVKGTKKLSSAQKFINWSVSKAANEAYAHNFSMVAYKGIENTTMDFPKNLPQMLVKNDFYWAAEQRERILAEWSKRFEK

SEQ ID NO: 6518 - protein, 64 aa, Acinetobacter baumannii
QTSHLGTGTPEGVPPPSYRYEGGRTSSPPKNYFFDVLDENGLLKPTGNVGQQAKDSIRYCWRQA

SEQ ID NO: 6519 - protein, 633 aa, Acinetobacter baumannii
CAFHGVKEMQMNATQSQDRERFVKLGQHDIHYHHKDDTLYISPKEQLKPYPQKLTDRLIHFAQTKPDHIFAAKRNAQGEWVKLSYAEVLQRAWHIAQALHARNLSQERPLVILSGNDLEHLTLSMAAMLAGVPFSAISPAYSLISQDFGKLKHVFEVLTPGMVYASDGQAFAKAIQACITPDIEVVTNKGIVGDQICTSFQSLLDTPVSNVQEFYQTLDENQIAKFLFTSGSTKLPKAVPTTHLMLCVNQQMLLQTFPEFEETPPVLLDWLSWHHTFGGSHNVGIALYNGGTIYIDDGKPVAGKFDETIRNLKEISPTVYLNVPKGWEELTEALEKDEELRERFFAKVKILFFAGAALSEAGWNRLDKIAQQHCGEKIRIMSGLGMTETAPSCAFTTGPRVMAGFIGYPAPGCEIKLVPCGDKLEFCVRGKHVMKGYWRLKADQQSTIFDDEGFFHTGDAVRLVDVNDPTKGLMYDGRIAEDFKLNTGTFVNVGTLRNKVLIQGNLLIQDVCITGSNLNAIGFLIFPKLDACAQYAGLKLGEYSAAEILQHPKVQQWFRQFLTTFNKDATGSSNTVSMLYLMTEPPQLDAGEVTDKGNLNQSSITKRRAALIDELYQKQTDNPLIIRVPTLKQ

SEQ ID NO: 6520 - protein, 248 aa, Acinetobacter baumannii
FNFQILLSALILVPNCYAIHFYLECFMRKSLIWINLIIAMGALGFTNAVNAKDEYPLHMAAANDDIQLIKHILSQKTLIDARDETGSTALMVATRANNIHAAHMLIEAGADVNAKDNIQDSPYLYAGAQGYLKILRMTLMHGADLKSTNRYGGTALIPAAERGHVETVRTLIAAGVNVNHVNNLGWTALLEAIILGNGKSNYQQIVALLLKAGANPNLADKDGITPLQHARTRGYREIEKLLLVAGAK

SEQ ID NO: 6521 - protein, 284 aa, Acinetobacter baumannii
NKFQNKHHKRNIVLICETRNSKMSVSTGNNFVEVDFSIQKIAVVKINRPEAKNALNGEVRKQLAQAFTELSFNDEINAVVLTGGEEVFAAGADLKEMATATSTEMLLRHTERYWNAIAQCPKPVIAAVNGYALGGGCELAMHADIIIAGKGATFGQPEIKVGLMPGAGGTQRLFRAVGKFHAMRMIMTGAMVKAEEAYTIGLVSQVTEDDQTIPTAIQMAQSLAKMPPIALQQIKEVALMSEDVPLNAGLTLERKAFQLLFSTEDKNEGVQAFIEKRKPSYQGK

SEQ ID NO: 6522 - protein, 71 aa, Acinetobacter baumannii
DCIQNSVANLVGHFIGMTFAYRFRGKNSVLAHESPILVISKRHNMLHRLELEDQFILTKKHEFLSFLLCFN

SEQ ID NO: 6523 - protein, 520 aa, Acinetobacter baumannii
ALIHVFNSCGSICCTAMRDVLEDVINRKMQEDKNMQAVVYHSQDIQAWEQRWFAAQNSSLGLMQQAAWSITQQLIVLFQKQNFKNIAVWCGQGNNAGDGYFIASYLKQAGFHVEIFAAELGESTDLHHAVDFAKENDVQIYQGFEANRTFDCHIDALFGIGLNRELNGYWQHAIQQFNGQAGLKISIDIPSGLHANTGSTLPCAIRADHTFTVLGLKAGLFTGQGKEYAGQIHLINLIPIDQELKPLAYLTPTHIKLPKRLAFGHKGSYGHVLVIGGHEQMGGAVIMAAEAAFHAGAGKVTVVCHRNHHQAILSRAPNIMLRDINDFDEDGIKEILSQVDAVCFGMGLGRDDWAHQIYQQWFNYLNQTSHLEVVLDADALWFLAKQPEKLSLHIYATPHPGEAATLLGCSTWQIENDRIAAIYTLQQKYAGQWVLKGAGSLILEDNLYICTQGNAGMGTGGMGDVLAGMIASLKAQFHKAVTLHEIVTLHAQAGDQLAKQGMRGLQAYEMNQAITQVVNQ

SEQ ID NO: 6524 - protein, 75 aa, Acinetobacter baumannii
RHYHALCKFEMLVISTQHTKYKIINFLVFQEIHFEFKFFKNIYKFFAHYVDIRFISISSNIIRQVDSLRAQKSPY

SEQ ID NO: 6525 - protein, 266 aa, Acinetobacter baumannii
IRLQYSIFQVFIIGLLPRCIVSNQQQMAAQTATFWQGAKDSQAIVLTYLPVSFAFGVSASQFGFTPWEAFFLSCSMYAGASQFLVVALLASGSSIWLTALTVIALDIRHVLYGPALYNLIPTKLNLKKTAVWAWGLTDEVFASGMIQLSQRRQQWSESWMLGLSLFSWMSWASGSLLGGLFADQVAHLPKFLQAALDFLLPALFLSFLLAAFERKHSLVVAVSLVVSALACYWINLSAAIFIGILSGILAGLFKYYVLKQFDEVEA

SEQ ID NO: 6526 - protein, 97 aa, Acinetobacter baumannii
KYSQPYFFFVKIINIKNIEIIIMINKVLIVLCVSIVFVLGYWAYLDTQNKRHQELMRIIQEAEKNLQTIERNPNRVSHSNLASYNLQKYISDKKVFF

SEQ ID NO: 6527 - protein, 444 aa, Acinetobacter baumannii
PSKHAYPAVNINAPRTGASFWKWIMEFVHRFKPCNLAITTLFGLLTSSSLWAADTTQQSEDEWKFTLKNAYINRNFDNDALKDTGSWSQAASLFYKSKMHDTPLQIADKPITIGADASVQYAVRLSSDKHVADTVLPFNKETQSQASDFLKYGATLKLGYDKTLLSVGELWLDLPVTAVDASRQLLASYWGTNLKSQLSDQLYAEIGRVEKVSPRNEEDFKKFSFTANGMTKESDGLNYIDLRYQFTPSLKGEYYFGNLEDLYNKHYVGLEHTWKQPTFALTSKFKYFNAKDDGNTFDIDAQNIGVLETLKVKNHTFGLGYQQIIGESAYPLPDGFLPETYFINWNATGFFKEDERSYHVMYGYDFKDYVPGLNAMVKYVYGHDFKAANGEKNHETESNVILNYAFQQPLLKGFALQYIRIDYNVKHGNDFGEDRLFVNYTKKF

SEQ ID NO: 6528 - protein, 229 aa, Acinetobacter baumannii
QQLHNLRYLAMQDQLIDLLITGTIDTLLMVGASAFIAFLIGLPIAVILVSTSEHGIHPSQKINQALGWVINITRSVPFLILMVALIPLTRWIVGTSYGVWAAVVPLTIAAIPFFARIAEVSLREVDQGLIEAAQAMGCNRKQIIWHVLLPEALPGIVAGFTVTIVTMINSSAIAGAIGAGGLGDIAYRYGYQRFDMQIMLAVILVLIVLVMLVQATGDALAQQLDKRKV

SEQ ID NO: 6529 - protein, 147 aa, Acinetobacter baumannii
KIMQGLKRRIVYVSSYEIIGMVISSVGLALLAGDSVEHTGPLSVMITTIAVTWNFIYNILYEKWEARQESKSRTVKRRIAHAIGFQITLVMFLIPLIAWWMNISLVAAFWLDVAFIIVIPIYTFIFNWTFDKLFGLPASAQPSTAQQ

SEQ ID NO: 6530 - protein, 538 aa, Acinetobacter baumannii
IRMHLMNQLQSKINVRSEDFKTNQQAMQTLVTDLKQVAQRIALGGGENARQKHLSRGKLLPRERIDQLIDVGTAFLEIGQLAAYNVYEDDVPAAGVIAGIGQVNGVTCMIVANDATVKGGTYYPLTVKKHLRAQEIAEQNHLPCIYLVDSGGAYLPMQDEVFPDRDHFGRIFYNQARMSSLGIAQIAVVMGSCTAGGAYVPAMSDETIIVRNQGTIFLGGPPLVKAATGEVVSSEDLGGGDVHTRLSGVADHLAENDEHAIAIARNIVANLNKKPNELNKQIDEPLFDASELYGVVPSDARKPFDVREVIARIVDGSRFDEFKARFGSTLVTGFASLYGMPVGIIANNGILFSESAQKGAHFIELCTQRNIPLLFIQNITGFMVGRQYENEGIAKHGAKLVMAVATANVPKLTLIIGGSFGAGNYGMCGRAYSPRFLWTWPNSRISVMGGEQAASVLSTLKRDQIEQKGAEWSAQEEDEFKQPIREQYERQGHPYYASARLWDDGVIDPAQTRHVLGLSLAAAMNAPIQPTKFGVFRM

SEQ ID NO: 6531 - protein, 332 aa, Acinetobacter baumannii
TAVQHVGTIFLNGFLLRKYRQRSILIFMILVQLPVLFAYVWNKHWRRLLMTDIESLLNKQDFIELSARERAKALLDEGTFRELLDPFARVMSPWLVKQNIVPQADDGVVIAKGTIQEQPVVLISIEGLFQGGSLGEVGGAKIAGALELAVEDNLKGIPTAAILLLETGGVRLQEANLGLAAIAEIQAAIVNLRQYQPVIAVVAGSVGCFGGMSIAAGLCSYIVMTQEGRLGLNGPQVIEQEAGVQEYNAKDRPFIWSITGGNQRFASGLADAYVDDDRQKIRQQVIAYLTQGVPHQHRSSNYSFYLEKLQQVDTAEQITPAQVQALYQGEQV

SEQ ID NO: 6532 - protein, 64 aa, Acinetobacter baumannii
LMQQALQQPQTLCIKHLAKNYSKRWVVKDVSFSMQSGQIVGLLGPNGAGKTTSFYMVVGLVRMA

SEQ ID NO: 6533 - protein, 270 aa, Acinetobacter baumannii
TMQQNNKTQSELKTGTIHKYFDRNILTLTMSNATKKNAINYEMYAALSQALDQAAINQDIHVVVLTGEDSAFTSGNDVNAFEKRDTTSSEPPASIVFLKSLATFPKPIIAKVNGVAIGIGSTMLLHCDLVYASQNSIFQFPFVNLGLVPEAGSSYILPRLLGFARASEIILLGEKFSAEQAKNYGLVNEIFEANELDQVVEDVAIKLAHKPSQALQLSKKLLRDMPIDDLLNRIDHESTIFSRCLQGSEFKEALSAFKEKRKPNFHNQTA

SEQ ID NO: 6534 - protein, 189 aa, Acinetobacter baumannii
CAWHKGEIHLDDLDMSDLAMHERARKGIGYLPQEASIFRKLTIAENIMSILETRKDLNKQQRQQRLTELLNDFKISHIKDSLGMSVSGGERRRAEIARALAADPKFMLLDEPFAGVDPISVGDIKDIIHTLKDRGIGVLITDHNVRETLAICERAYIVSEGSVIAEGTPQEILDNEQVRKVYLGDDFTV

SEQ ID NO: 6535 - protein, 255 aa, Acinetobacter baumannii
GEWQMNHSVLSKFLLHIGDSQLVLSQRLAEWCGHAPELEIDIALANIGLDLLGQARNFLTLAGQYDEAQRDEDQLAYFRTEREFLNLLLCEQPNGDFAQTIVRQWLMDHYHLHLFTALAQSSLPELSALAVKSLKEVKYHIRFSTSWMERLSLSTDEAHQRVQDGLNNLWRFTAELFELSADEKALVAEGVIPDFSNEKEQWNQTIADELKRFELNVAVNGAYRRGAKQGLHTEHLGYLLAEMQCIQRTYPGMTW

SEQ ID NO: 6536 - protein, 151 aa, Acinetobacter baumannii
GVFKGRFVNFYTIYPSEYIDRDFSFDLKGKQEIIVDYFKFDLSNQFLKNPRINLDYDNIFSDQLNEILDTDFYYSSSGILLFSKRFFNEMKEVLADECDFYQCYVRNQEADIYAMYIKRKNNLLDEDDFIKNDLVIDDFLLLEILINYIST

SEQ ID NO: 6537 - protein, 416 aa, Acinetobacter baumannii
LHFKTRLNGVRTMKASLASSTSSAESDKPLSSMPRGVILLFAIASGASVANVYYAQPLLDILASDFNVSHAAIGGVVTATQIGCALALVFLVPLGDLVNRRRLMAIQLMALISALLIVAFAHSTIVLLTGMLAVGLLGTAMTQGLIAYAASAAAPHEQGHVVGTAQSGVFIGLLLARVFSGGISDIAGWRGVYFCAAIIMLMIALPLWRRLPHLNVQPVTMRYSQLLTSMLKLLRQEKVLQVRGVLALLMFAAFNIFWSALVLPLSAPPYNFSHTVIGSFGLFGVIGALAATRAGQWADRGYAQRTSLAALLILLLAWWPLSLMTYSLWALMIGIVLLDLGGQALHVTNQSMIFRTRPEAHSRLVGLYMLFYAVGSGLGAISTTATYAYAGWLGVCSLGACVSLLALLFWWRTMKL

SEQ ID NO: 6538 - protein, 80 aa, Acinetobacter baumannii
VIFKVVRMFVYFTDGTCINDSEIYGVKAKYEQNKYVVEVTIKPTHVLATTPSVQFKKEIFDDPILANQYLSHNFNMPPFF

SEQ ID NO: 6539 - protein, 245 aa, Acinetobacter baumannii
IRFKNQIHEWIIHMTKLVVFSGAGMSAESGIRTFRDSNGLWENYDIQQVATPEAWERNPALVQRFYNERRKNILEAQPNEAHQYIAKLQDYYDVQVITQNIDDLHERAGSQNVLHLHGNIRLAKSSGPDAQYTTQFYEVNGWKLDLEQDFCPDGYPLRPHVVWFGEAVPAYEEAIRLVQSADIFIVIGSTLSVYPVAALVHEIPHYTKAYYIDPQADHSRVPPQYKLLNMTATEGMHELFHQLTS

SEQ ID NO: 6540 - protein, 243 aa, Acinetobacter baumannii
KMFKDILRRFAFLFVFLPALPAIWYGCQYAFYLGQTEAIGASLAEAGLSNYEVTFFGSLTFTEILFESFDKIKIAFHKLILIFIKVISFLTLMFISLWIGYHPSRRYEIKSFIYLKYSALKFYYTYNYKTPKPIKLLEYYYFTIFVLFLLTIGFAFIHNAYKKGEKNIKENLYQIYIKKDYSFSGTVTEGDKKYKAYKIVCGNYKCIGLDLDNNRNTTFLPEQYKQNFDYQTFKDKFKEKKSS

SEQ ID NO: 6541 - protein, 78 aa, Acinetobacter baumannii
FIIKLQLSSQLFQVGHVHLLHLLFICFAELIPLKLLTCFYFNLCFNLLSIIKLIYLHLNVAIIDYNVNTCTIKWLKFF

SEQ ID NO: 6542 - protein, 535 aa, Acinetobacter baumannii
RRIKKDKQMRFLSVNADCFLIELASLEETLALYNKLQNTQLNGIKDLVPAAKTILVFFNEIETNFKTLVASIQSLKVDSGFERSGQEVIVPIRYDGEDLAQVAELQGLSVADVIRKHHQSVWNVAFIGFAPGFAYMSSPDKPFTDIPRLTVPRKKIPSGSLGLAGKYSGIYPKDSPGGWQLIGTTSEKMWDLERKNPALLLPGMTVHFEDVTHRPTTVNVPQQITCKAEPKQSLPLFTITAPSLQMLIQDEGRLNQTNIGVGVAGAMDLSAMHSANRIVGNPTDTPVIEVLNGGLKAKMQHAGVIAVAGAISNIRVKFADGQTADFASYQPIDLDEGDEFQIQPPTAGLRNYLAVRGGIDVEPILNSASFDSLAVLGPEPLKLGDTIYQGQVKAANISVNEVGKSNLPKAGEVVELDIVMGPRTDWFEQDSIELLCQQEWLVTNESNRVGLRLSGEQPLTRKITHELESEGTCIGALQIPPSGQPVLFMNDHPLTGGYPVIASVAKHHWDLVAQIPAGCRIKFKKIAEFTDFENE

SEQ ID NO: 6543 - protein, 179 aa, Acinetobacter baumannii
VMVKNALQAQLLKAGLVDNKKAKKLTKQAQHEQRTGQSNEAEIKANIEKAQKEKQAKDQALNLEKQQQLEEKALKASIIQMIKQHKIVDFAGDVAYQFIDKNKIKKVYLSQQVYNALVTGSLVIAKDQDQYAYLPKALAEKIDQKMKGFILINNAEKNEQTTDEEDPYAAYVIPDDLMW

SEQ ID NO: 6544 - protein, 136 aa, Acinetobacter baumannii
NMVNTAQAQSTSTPYRVTLTDPSGHQWFADEPTDKGGKDTAPNPVQLLLSALGACTTITLEMYANHKGIKIEHVQVDLALNPNGDPEAGQNNIERKITLKGEFTEDQHKRLLKVAENCPIHKLLTSNITIQTELNI

SEQ ID NO: 6545 - protein, 72 aa, Acinetobacter baumannii
FMSNTTGTVKWFNETKGFGFIQTDEGKDVFAHFSEIQTQGFKVLLEGQRVQFTVTQGKKGPQASNITIVTNA

SEQ ID NO: 6546 - protein, 307 aa, Acinetobacter baumannii
PYPKGIPMLDLYKLHAFVVVVEERNITHAANRLFIQQPPLTRLLKKLEQELGTQLLIRQPRGIEPTEAGLALFKEAQLLLEHARHIPKLVQDVSQGKTGQLNIGFTSSAGLHPLISLVLRSYREMYPAVQTKLEEAGSQKQLDWLISEKLDIAFLRAPISRDIGLKHLHILNEPMVVALPIGHPLTQKKKISLSNLSEENFVLYRRSSGQGLYDNILYSCYQAGFSPRIIQEAPRPTATLNLVAAGIGISIVPASMHNFWDHEIVYREFDDSIKLNAPIYLITRENENSAKVSNFIELMQKLLPIMT

SEQ ID NO: 6547 - protein, 352 aa, Acinetobacter baumannii
NTPKEEGAKKMLLKVGELAKQTGLTVRALHHYDDIGLLQPSARSDAGYRLYTRKDITRLHQIQALRGLGMSLAEIYTVLEDPNLALLPIIDQQIQAIDQRLAEQKKLRNQLGQLKSQLINGEELDLEDWLNMLELIAMYEKYFTQEELEKLTFLQSGTKTHQEWQELTQAVNTVFNAGESSSSETAQKLAHKWMKTLEQNTRTNPEWLVKLNNINSAEPEFQEKLGVMPEVVEFLLKAFSESKLSIFARYLSDKEFAFLKENYVREMKKWPQLLVDIEKLIDAEVKPNSEGAKRLAQQWLSMLQGYTGENPSTQEKIRSAMQNEPSLADGTWLKPVTLHFLEKAVAAFKHSA

SEQ ID NO: 6548 - protein, 62 aa, Acinetobacter baumannii
IACFLKVCTMKMYLLSLAVGLLVGVLYYVLNVKSPAPPLVALVGLLGMVIGEQLLPFIKSYF

SEQ ID NO: 6549 - protein, 477 aa, Acinetobacter baumannii
KMAKTQLQHFINGEYVTSKGNDFFDLVSPVTGEVYAQSPNATEAEVDAAYAAAKEAFKIWGRSTPSTRQKALLNLADAIEANADRLIEAQSRNTGQLKHLIASEEVGASADQVRFFAGAARLLDGTATGEYLEGLTSSIRREPVGVVGQVTPWNYPLMMAVWKIAPALAAGNTVVLKPSDTTPESTLLLAEIAAPFFPKGAFNVVLGQAQVGSKVVSHKTPALVSITGSVRAGLQVAASAAANLAKAHLELGGKAPVLVFEDADLDKAVEMIALTGYFNAGQDCTAATRVIVAESVHDEFLAKLVEAAKNTRFGDPDDQDALYGPLNNANQLKNVKAFIDNLPAHAKVETGGKQADRPGFYFEPTVISGLKQHDEAIQNEIFGPVITVQKFTDENDAIEKANDVEYGLASSVWTKDHARATRLSRELDFGTVWINTHIPLTAEMPHGGFKKSGYGKDLSGYGFEEYTRVKHVMSSNE

SEQ ID NO: 6550 - protein, 408 aa, Acinetobacter baumannii
LHYKHTEKELMNFETYVKENFIATFNKLFRKQSSNLLTIKYYPEDLSFNEFNLKKEKILAEVLNDLATKTYSPTSLHPSFLEKSDGSLRLICIPSIKDRVIQKLILKYIKEHHESKYILATNHDFSAKISEAGAIKARTKALILRNQNPYVLKTDISSFFDNLDRRLAIKTVKEKLDIPEINYLLERIIKVETRFQKDNLNNEKENALLKSKKGKGIRQGMPMSSFLASLYLHDFDNFIEKENIKCVRYADDLIIFCSSRKQALNYLEKVTIELEKIKLNIPPLEDKSKTQIVKNKPIDFLGLEFRFGGTKFKAYVPDVVFKTIHRKLEVYDSLNKNLKNKKDFSDVIQDIKYISNGYSAAFPDACNISELEYEINTKKIIIFSKLLTSLGLDIERLSARQKKFFFSI

SEQ ID NO: 6551 - protein, 339 aa, Acinetobacter baumannii
SVHKHRVFDYESSGHDHLNGHGGHHRRHRHHDGCDHGLGHLNDHDHHLHRHHHNDCGHGLDHLNDRDHHLRHHHHDGCDHGLGHLNGHGHHLHRRHHNGCDHGLGHLNGHDHHLRRHRHDGCDHGLGHLNGHGHHLHRRHHNGCGHGLDRLNGHGHHLHRRHHNGCDHGLGHLNGHDHHLHRRHHGGCGHDFGHLSDRDHHLHRRHHGGCGHDLDRLNDRDHHLHRRHHGGCDHDLGHLNDRDHHLHRHHHGCDHGLGHLSDRDHHLRRHHHDCDHGHDRLSDRDHHLRRHHHNDCGHGLDHLNGHRHHLRRHHNGCDHDHYDHRFYDLKHQLHEPLLR

SEQ ID NO: 6552 - protein, 262 aa, Acinetobacter baumannii
MLNKLKKLIGLVGLTSLSTVSCAQQDQEAIWQNVYNTRTQYYEENIGKLPDDILKIAHMAGVWPGGGLYVIPADKIGKDITVYSTFGLTNSDMPAQATVSDVKVEKDNLGRVVSSSANVKSKTQTAALSGAAGYGYELILMTKDKNAEWPLWFLQWAVQAELLNDAGFLKRVEKYNGLTVEAISVGENENDKINVLITKAQKPLPLGTQLPNGKMEFLVAIVITDEEMKWSMKNGRNELASKLMEAGVGQLSDRNRPSVIGH

SEQ ID NO: 6553 - protein, 356 aa, Acinetobacter baumannii
MPNNVYKNTNAIIEGNYDNTSLGANTYLLGLTSLFDEMGLQGHSISDVLSGTNISPDAMNQSSLYISQVQKIQLFQNIQKLSHDPLIGLRAGQKQRLSDFGVYGYALYSSRNFRQAVELGIRHIKLAGPILKKSFYIRDDVAVFEGQDIIALGKLLPLVCEFWFSSMQTLIERVLEGPFQAKKLLLPYPAPDYAEEYEKVFRCPVQFNVGVMQWHFDLKWLDVPCPNANPITADMCKSFCERMLGAAELEEPELVKTIRLILLDGTGLFPSAQEMAERLHISKRTLHRRLAGFDLTYQELLDETRRRLADEYLRETTLTIDEIAERIGFSDTSNFRKAYRHWTGISPNEYREKLVL

SEQ ID NO: 6554 - protein, 261 aa, Acinetobacter baumannii
NHNNKGMKMARKVLISAGGSGIGRCIAEVFLNNQDEVFVCDINAKSLEQFQQDYPKLHIYTCDLADHEQIKLMFSQTIQKLGGIDILVNNTGISGPTVAADELSFEDWNTVINLNLNSTFLITQLAIPYLKQAQAGVIINMSSIAGRLGYPYRLAYSTSKWGLIGFTKTLSMELGADNIRVNAILPGAVDGDRVQRVLQARADVAQTSLEEVTQNALKNQSLKYFVNPKHIADLCLFLASDSGRSISGQILPIDGDKQCLS

SEQ ID NO: 6555 - protein, 316 aa, Acinetobacter baumannii
NPNNFCLMSTNQSLVLLNEMATFVKVVESESFSETARQLGTTPSAVSRAIARLERALGTRLLYRTTRKLRLSESGQQVYQRCLDMVNAAQAVMESSGQFHVEPEGIIRMSVPKAVGHFMIHPHLPEFLERYPKIDIQMLLEDRYVDLIDDGVDLALRITEQPPGGLMGRKLIDIDHLVCATPEYLAKHGTPNHPHDLKQHECIYLGEQASDSKWKFQQGNKSISVAVRGRYAANHTGVRLSAALQHFGIASLPYFVARHALQQGTLVQVLPDWYFKTYYSGGLWLLYPPTRHVPPKLSVLIQYLADKLAVEPTLKI

SEQ ID NO: 6556 - protein, 355 aa, Acinetobacter baumannii
RMNNLNFKTLKKYWLRFVGIAVIAGALVLAFAWTAGLFGHRTTSKTFLGDTLKNFDPGYRRAHGKGICFDGTYHSNGAAAALSKATVFAKSDIPAIGRFSIGSGNPHAADNSTATVSMALLLSPADHSQWRMKLNNFPYFPTRNAEGFLAQQKAFKPVPSTGKPDPALVEAFLKEYPEARKSIEQKAKMPLTGSFSGAEFYVVNAFILRAANGQEQPVRWSMRPHSKFISLTKEQHDQADHDFLFKDIKKRLAEGPLYWDLVLQLAEPGDPVNDPSQPWPKDRKEVIAGTLEVKNVTDQVNGACRDINFDPTLVPPGIELSDDPVLAARAAIYSQSYNARLREIGFGKATDAVGK

SEQ ID NO: 6557 - protein, 148 aa, Acinetobacter baumannii
FIDKFVMTELVKIYHNPACGTSRNTLALIRHAGIEPIVIEYLQTPPSTDELIQLIKDSNLTVREAIRKNVEPYKDLELEQDHWTDEQLIDFMVQYPILINRPFVVTPKGTRLCRPSEMVLDILDSQNLGYFAKEDGEVIIDEQGRRLK

SEQ ID NO: 6558 - protein, 155 aa, Acinetobacter baumannii
AKSNTGSRLMLYLEDLKIGDRFISREYEITLDEIKQFASHYDPQPFHTDEELAKEDPIFKGIAASGWHTSAITMRLWTECMPIHGGLVGSESSLRWPRPTRPGDRIHVEAEISAITPSKTKLDRGIVSYVTQALNQHGDVLLISTTKIVVFKKNV

SEQ ID NO: 6559 - protein, 284 aa, Acinetobacter baumannii
LNFKFNLISLMNIKALLLITSAIFISACSPYIVTANPNHSASKSDEKAEKIKNLFNEAHTTGVLVIQQGQTQQSYGNDLARASTEYVPASTFKMLNALIGLEHHKTTTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 6560 - protein, 245 aa, Acinetobacter baumannii
NSFNIFFITNNLIFIMFFILRKKLQKIGIIFVAINLLACSHQPDFKDLKHLAESGDAGAQAKLGELYVEGQVVPQDYKKAFEWYSKAANQGNSEAQNNLGAMYALGQGVEQNYKKAFEWYSKAAEQGEVKAQNNLGAYYANGDGGVKNYQKAFEWYSKAAAQDNAEAKYYLGILYEEGYGVTQDYKKAFEWYSKAAQQENDEAQFTVGMMYYKGEGVQQNNELAEKWLRKAAENGNKDALSLFEE

SEQ ID NO: 6561 - protein, 465 aa, Acinetobacter baumannii
APLNFNFNAPNCCIYFKQNPLFIDNNCHAWVAFILSSFNPSFIVYMSDPQLSLSEYLGTVQEVIRLTFDEPVWVRAEIRNLNVKGGHYYLELAEKDADTDKVIASCKATIWKFSASKIVLKFERETGIELASDLNVLIKIRARFDPQYGFSVNIEEIDSSFTLGEIAKRYQQIVERLTQEGLIHKNKLLPTPFDIQNVLVIAPQNAAGLGDFKKDADALERNKVCHFVYQNATFQGNTAAVSLMESLATGLKQWANNFNFPPDLIVIIRGGGAVNDLAYLNDYELAALFCKRSVPIWVGIGHEKDRTILDEIAHRSFDTPSKVIAGIRNHIVERVQEAVDSLQTIKLLSQHQITTYQSKSDQYLQHIKSSAQAQLNSAHQFLEQIKERIQFVSQQQVKFSLSQTESLMREILLQNPKQIQAKGYAIVRSEGKAIRSIHQITSSTITVDMQDGAINANITEVIPNE

SEQ ID NO: 6562 - protein, 359 aa, Acinetobacter baumannii
HSIKNLTGKTINYYDRGSLQMKKMLIKSGLLITSFFIYNQTYANCTLSKGFTTVDIPMTIGTIVVRPTDPIGTVLQKNTFTISPNNSTATCNRASDQITAALPLNYPVSSIGNNVYATNIPGIGIRLYREAFDSTDFSGYYPYKRTLTPNTTYTLSPGYFVMEVIKTAATTGSGALVAGRYSTYYVTGQQNRPFLTTTVLSSSPILIASSSCEIQNGIDTVVQLPTVMKSGFRAIGSTQGEKNFNLSILCNGGENNSGVPTSNTLSLSFDYISDTSNSQVINNSAADSTKANGVGVELLWNMNGANNSIRKGNKLDIGTVSSNQTVQYDIPLTARYYQTASNVTAGEVKANATVTIQYD

SEQ ID NO: 6563 - protein, 260 aa, Acinetobacter baumannii
KEIKMNKQEMKDLVTKAHHELFNLHDTTALDRYFSEDFIEHSPLVANGISGLRQLVEDCPDMQHEAVRVLADGDLVAIHGRFQGLDENPLVGFDIYRVKDGKIVEHWDGLVAEAAPNVSGRTQLDGPTEIVTHHDPEKNREIVTSFFKKSLIDGNYEAFKEYTDGDQFIQHSPDIGDGVKAVIDFLNNIRNEGQGLVYSKTHRSIADGQFVLTHSEGSIAGNRHAYFELWRVDNGKIVELWDAIPAVPEDEQAVHGYGVF

SEQ ID NO: 6564 - protein, 406 aa, Acinetobacter baumannii
SGVNMEDVLICDFIRTPIGRYAGALSAVRADDLAALPIKYLKDKHPNLPWNTVDEVFLGCANQAGEDNRNVARMATLLAGLPDTVPAMTVNRLCASGLDAVGLAARSIKAGEAQFVLAGGVESMSRAPFVQAKPTEAFSRTPEIYDTTIGWRFVNKQLKAQYGTDSMPETAENVAEKYQISREDQDAFALRSQQKTAAAQQNGFFNDEILPVEIVDRKKNVVVVNRDEHPRETTLEALAKLKAPFKKEGGSVTAGNASGVNDGAACVLITNREFANTYGLKPLARVIGIASAGVEPKYMGIGPVPAVQKILKQTGLTLDQMDVIELNEAFAAQSLACMRELGLKDDDERVNPNGGAIALGHPLGMSGTRLVITATRELKKRGGRYALCTMCVGVGQGVALILENLN

SEQ ID NO: 6565 - protein, 345 aa, Acinetobacter baumannii
NMTKQGLSFLDRNLTLWIFIAMALGLAIGVFFPQASVSLNELSVDNVNIPIAIGLVLMMYPPLAKVDYAALPEVFKDKKTLTLSLVQNWIIAPVLMFILAIVFLHNYPEYMTGLILIGLARCIAMVLVWNGLACGDNQYVAALVAFNSIFQILFFSTYAWLFLTFLPPYFGVAGQVIDVNFWTITHAVLVYLGIPFLMGFLTRLILVKSKGLDWYQTKFLPKISPLSLVALLFTIVAMFSLKGGDVVSLPLDVLRIAIPLTIYFVVMFFISFFMSKRMGNNYPRTAAISFTAAGNNFELALAVAIATFGLASPVAFTTVIGPLVEVPVLISLVSVSLWLKKKYYS

SEQ ID NO: 6566 - protein, 343 aa, Acinetobacter baumannii
SKDNFNCLIRRCLVFNKFYRVSKMVAQAIRNIISPKSVIAQYQKIDFSNKGTIPIRHLNIGFDGKEIDIEFYVNNQFATLFFATLSVFLTYGEDLVIETARHHREFIQDPILKQRVTSLIGQEAIHSKLHNEFNDAIKELEYPVDFYRFLGENFFKYVFLKFPQPLKLSLMAGIEHFTAVLAEYMMKHEKNFYYTDDAKSRALWMWHMLEESEHKDIAYDVYQVLNGNYPLRATGFLMAFITILGLIPTATLFVPLLRKPKELLTRKFWKDARRGVNLIFSPKDGVFGSTIGQIFDYLRPDFHPNDHDTTEYLEYYKKKLLNEGGAIAPYFVKEFTPPVRAVS

SEQ ID NO: 6567 - protein, 299 aa, Acinetobacter baumannii
IRLLQEREGEIMTTLTFQNVKHILAASLLSLGLVACDKGTQSTEKSADTTQTTSSIEQIKKNGVVRIGVFSDKPPFGYLDAQGKNQGFDVEIAKHVAKDLLGDENKVEFVLTEAANRVEYLKANKVDIIFANFTVTPERKEVVDFAKPYLKVALGVVSPKSHPITDVAQLKDKTLLVNKGTTADSFFTKTHPEIKLQKYEQNTETFDALKDGRGAALAHDNLLVLAWAKENPNYTVGITNLGEQDLIAPAVKKGDKELLDWLNQDLEKLAKEGVIHQAYEKTLKPVYGDTINPKDLLVE

SEQ ID NO: 6568 - protein, 227 aa, Acinetobacter baumannii
RTRKMAKDFNSPKVVEGYDVHIRKLIPGYEVIHQQVDAILQSVLPPDAHILIVGCGTGYELDYLLKRHPNWQFTAVDPSLTMLQKAQEQVEILGKSTQVTFVHGDTSALPLEPCFDAALSILVAHFIADDIKPAFFKDIYDRLKEKALLLTYDLMTCVNPQQLQALHYLCLAQGLTEEQCQKMLERMAEDFFSLTTEGYIKLLEKIGFESVQPYTQILTYQGFIAKK

SEQ ID NO: 6569 - protein, 252 aa, Acinetobacter baumannii
NRRNIYKLLIFLMRKFLQSMLPLCIIPAIMVGCASSPQHTTTGKTSPNGKRIFIPQERVIIERPIPPKVEPASYRAWLNTGDHYERVREYEKFLARHDVAGIVPSFELLRSARDWQKCGRSEYAVPNRELWNNSLSTLRVFKYLIAAKVLTDFEVTSVYRDLPLNECAGGASSSKHLFNSAIDFRIGPEVPQPQDYAFIENTKFKLCQFWAQHGQSLNLGIGLYSSGQIHIDTQGYRTWGPDLTRNTSMCNF

SEQ ID NO: 6570 - protein, 91 aa, Acinetobacter baumannii
AFSKEINMLILTRRVGETLMIGDQVSVTVLGVKGNQVRIGVNAPKEVSVHREEIYQRIQHERAMHEHLQHLDQDYQVSYEDDNYAQKNFNR

SEQ ID NO: 6571 - protein, 214 aa, Acinetobacter baumannii
SISNLCCGSGNYQHCFSKNSFIFDYADFTCVLFSHHLETCVMGAVLLTLAIIFTQLSLIAFGGGNTILPEMQRQVVDIHHWMTAQEFSALFAMAQAAPGPNMMIVPLVGWHVAGLSGLLVTSTAKFLPSSLITVFVMRGWSKFKDKKWRRVLQLALQPVTVGTVLASAWIISEAAAINTLLIIMVVIATLLSLIKKVHPLHVLIAGAVFGVVLL

SEQ ID NO: 6572 - protein, 101 aa, Acinetobacter baumannii
KCSKPIKTTTVEVREGGLPMLYQYHCACCDKVVSSTDKSCPYCGSHHIRSPYGLWMFCVMACLAVVVVFKVVHLYIQNHQDTPVQSTLLDVLNEGDKSTKQ

SEQ ID NO: 6573 - protein, 89 aa, Acinetobacter baumannii
SILKQMSFPTLDANNSEYYPLPAGLHCQSVLADRFHLEHQKSNFLVVNSFVPLRSGRTEEGRLRACQFLDDWSANPLSFCHHNHLAVIW

SEQ ID NO: 6574 - protein, 463 aa, Acinetobacter baumannii
AILKSWHSFCYAHIGNLLYPMWGMPVKNIKTLILAMSTISLTGVVMPAHAATDAEVDALRKEVSELKQLVQQLSNQQKAVTVVNTPTVPPTTITASSPVPQSKPGWMQMPDGQTQVKLYGNVRVDATYDFKGSNGSISNGANYPLNKDDPRQDSLNVSAATTRIGLDLTRPTQYGDLTGKIEADFMGGNGDNGSGTFRVRHAYMSLGKWLAGQTTSPFVNTDTSPETLHFTGAVGTGTTRTVQVRYTQPINAQQKILVALEGGDVEKVSNAAGGSRFPALTTRYDFKTADNKGLLQLHGLAHENRVAPKDSSSEEKFGWGVGIGGKYDITPQDSVVANYYHVKGDGRYLSYSNSAYAYDTTTQDINLGEFDSAVIGYQRKWSPILRSTFAVGGIQYKDDSVYANSNLTNTSYNKEIYNALVNLIWNPVKNIDLGAEYTYGQRETFAGDKGDYSRINLLAKYNF

SEQ ID NO: 6575 - protein, 361 aa, Acinetobacter baumannii
DTLKHRCVHLVQLMKILTANKTLGRTVMIDLSLIWVGIIGLGVLIYVVMDGFDLGIGIMFPFIKNSQERDVMMNTVAPVWDGNETWMVLGGAGLYAAFPLVYSTVLSALYLPIIFMVIALIFRGVAFEFRFKAHRTKHLWDLAFIWGSVLTSFLQGIILGAYIQGIKTENGIFAGGPFDWLTAFSIFTGIGVVAMYATLGCGWLILKTEKGLQQRMYELMPKLIIALLIIFGAVSLYTPLTHPEIADRWFSLPNLFYFSPVPILVLLFVGLILSACKKQQDHKPFIYTLALVFLAFTGFVISLWPNIIPPSVTIWQAAAPHSSQMFALVGALILIPIIITYTIVSYWVFRDKVRVGDEGYH

SEQ ID NO: 6576 - protein, 443 aa, Acinetobacter baumannii
FDLKTKQGRHNNYALLKTKNVISGRNAMSKLWMYSTLMLSGSVWAGSFIDNSSVELTTRNFYFDRDYQEQSAYPAAKDWTQGFILKANSGYTEGTVGFGLDVLATAGFKLDADAEHGGTGNLPRDTRTNEPADSYGEIGVTAKAKMSQTELRIGTLMPMNPVLVASPARLLPQTYRGISLTSKDIKDFDLQAAYLDKVNHRDSTNYEKIKISGVNGRFKSAETDGLYYLGGNYQFNPALKLTAFYMDVDDLYNQTMVGALHQHKINDTTNFSSQLRYYRSRDDGQAKAGLVDNDLYHAHFELKHQNHKFIFGTFQHHGDTAFPYLTGGETGLLIDTWPGEFLNPKEKAYSFRYEYDFKDYVPGLRFMTRYTTGHNIYAPNLGGTNLKERETDFDLGYTVQSGWLKNLGLRARYAIYDNNMLSTANIKPVNETRINIDYTWKFK

SEQ ID NO: 6577 - protein, 343 aa, Acinetobacter baumannii
STLKMAPILLKNITFYENRNTDQKWGALDMGYVAKEFTQKNKLILSICSFVIPICLWCAISYLPFVWHPQVQITSSGSVPYLQVGSRVDKNVFYLEAQNAVNRDSAPPQGILVNPIYLPAPHEVAKALVTAFTTPHEQPDSPWFHQSLWHSIKLVFSAFFISSLIGIPLGILCGFSKRISLLTEPFVEFFRYLPAPAFGALAVAILGINDAPKIAIIVIGTLFQQILIIANTTRMVDRSLIEAGYTLGTNKLKSLFHVVIPAALPDIYRDLRVLLGWGWTYLIVSELIGTTSGITWFITQQARYQNFDNVYAAILIIGVIGLVCDWVLMKLGERVFTWKVGAK

SEQ ID NO: 6578 - protein, 86 aa, Acinetobacter baumannii
FILKNLIYRSFFMKRLKVVIKDQFDQESIALAKVRPANDQKLELYKSVEHIEIDDDIILPNMDLLYENPKDGKIYKLVGPFNEDEL

SEQ ID NO: 6579 - protein, 71 aa, Acinetobacter baumannii
NILKTVVKKVKKCWYGFLILCKANAILKLRKQIRSMSNSFMDGLLIVSAYKKANLLKLLSYSLTSWLTFIK

SEQ ID NO: 6580 - protein, 204 aa, Acinetobacter baumannii
IKLKDIGMKAILTKKIISCIAISGVLSFSAFEIMAANQQTINDGKNHSKILNENHENLTDSQIFKILSTANNGEIKQAKTALPKLKMDEAKKYAEMMIKEHSANEKSAQALANRLQLISQTSNLSKSLQNDSDKIVSKLNKITSDTDKNYMMSQVKVHRKVLTIIDKQLIPNTKSSELKNMLVQTRDAVAKHLKAAEDIFKNMK

SEQ ID NO: 6581 - protein, 313 aa, Acinetobacter baumannii
EGLKASTMDKFDTLQLFTRIVELGSFSQAADQLNIPRATASNAIKELESNLQCRLLERTTRHVRPSLDGQAFYERCTQILSELDDAESSLRNVIAQPRGLLRVDLSGAHATKIVLPNIDQFHELYSDIELVISTGDRLVDLIREGIDCVVRAGRLDDSTLIARHLVDMPQVICASPDYLNKHGTPEQPEDLLSHYCVNFFSTSGGRNYPFELMVNGKKQDYFLKSWIAVNDAENYVLSALQGAGLIQVPRYHVANELKNGRLVEVLSEWEIPKMSVSALYPQHRQLSPRVRVFVAWLSELYTGYFANFEYPQK

SEQ ID NO: 6582 - protein, 317 aa, Acinetobacter baumannii
FQLKSYIKLTAFSSTDIKMNFNSENIELFLTVLDTGSFSAAARKLNRVPSAVSMAIANIEAELGYHLFERTHRKVIPTAAALALEPQARIIAEQLRLLATHAYELSLGLESKLKIGVVSDANTELLFKAIKQLAEKFPLLNLEIITAPQDDILNLLYTENISLCLAGSNLNIKMRESLQLVMTETVIATISAHHPFLKEQNKLNTIEELINIRQIVVASSELDMEDSRSIIGAMYWKTNSLQTAINMVEAGLGWGNFPLSLVKEKIEQGHLVQLDFKNTKNHLPLSIYLIWLQDKPLSKAARELVQIVQANLSQTCH

SEQ ID NO: 6583 - protein, 850 aa, Acinetobacter baumannii
TGIKTMSEWFISSICFKKRTTYYLVLSLAINIPLTVYASDNMNRENILKADFDTNFLVGNAQKIDIGRFKYGNPILPGEYSLDVYINGQWLGKRKFVFKSTRSNENAKTCFTPDMLLEYGVKPEILHHEVSSTFTCNDLDKWVNDAFYQFDTSRLRLDISIPQVALQKNAQGYVDPRLWDRGINAAFFAYNASAYRIVNNNHETNHAFMGTNVGLNLYDWQLRHTGQWKWQDHNEIQEKVSSYTSNNTYAQKAFPKLNSVVTLGDYFTNNNFFDALPYRGINISSDDRMLPNSMLGYAPQIRGYAKTNAKVEVRQQGNLIYQTTVTPGSFEINDLYPTGFGGELQVSIYETNGEIQKFSIPYASVIEMLRPKMSRYSFTLGHFRDANINLKPWLVQGKYQRGINNYLTSYTGFQATENYQSFLIGSAFATPIGAISFDATQSSAEFEQKPTLKGRSYRLSYNRLFTPTNTNLTLATYRYSTENYLKLRDSILIRDLQQQDIDSFSVGKQKSEFQITLNQGLPNQWGNFYLVGSWINYWNQPNRNQQFQFGYSNQFKDLTYSISAITHELDQENQNSGHETQYLLSLSFPLQFKKNTVNFNSSISEDSRTLGMSGYIGNRFDYGSSISYQDAGQTSLNINGTYRTNYTTIGASFGQSDTYQQEMINLNGSLVAHSQGILFGPDQVQTMVLVYAPQATGARVGNTSGLSINKQGYAVIPYVTPYRLNDISLDPQGMPSTVELTETSHRIAPYAGSITKVNFSTKTGYAVFISTQTPNGGHLPFAAQVFNQNNEIVGMVAQGSRIYLRTPLTQDHLYVKWGQSNSEECQLDYDIQSKILQEKQSIIMTEAVCK

SEQ ID NO: 6584 - protein, 114 aa, Acinetobacter baumannii
NSIKYEGILMTDQNTDHAQLVAGDHNYSDSRWRESYLTRPYYQEAQLTTPDLDYDRDFSAAYELGHRARSESKEGTQFEDMEGSLQQKWEELKAESRLKWEHAKQAIKDAWDDM

SEQ ID NO: 6585 - protein, 315 aa, Acinetobacter baumannii
NTINYKIFMKFSKKDLNVSLTDIRLNPRTARNHSRSMKMSYENRWETVDVKVEDGIAWVTLNRPEKKNAMSPTLNREMIDVLETLELDQNAKVLVLTGAGDSWTAGMDLKEYFREVDTQPEIFQERIRRDSCRWQWQLLRMYSKPTIAMVNGWCFGGGFSPLVACDLAIAADEATFGLSEINWGIPPGNLVSKAMADTVGHRASLYYIMTGKTFSGKEAETMGLVNKSVPLAQLKAEVTELANCLLEKNPVVLRTAKNGFKRCRELTWDQNEDYLYAKLDQCIHRDTENGRQEGLKQFLDEKSIKPGLQSYKRTG

SEQ ID NO: 6586 - protein, 668 aa, Acinetobacter baumannii
FAIKNYSIFLKKLVKFLYFLDKTNFLMTDIRNIIKLANTYEFTQLEKILNKVAIQDLEQILQQINYHVNLINQRQNNKSKKINEFRTNLERYYKNKGIKTNLFDNIRVIEYLYRQILEDRIKILGKYNSEDIIHTQFSLINYLYHQILKHTDTIKEKEYKYFENLMNAKSEYFNGDDLDKHIEELSKVFYMTLMISSYENNWFNKKSHEAIIPYEIFNKNKEKNKLDEEIKISEELVFNTGFWDITEDIDFKLRFFKDEIVIENGKIYYTNKIWEELGNYALIAKIRQQRMLAQKTFEASAILYNFGLKDSVKLNYLSLQAQFEDLYYDDIEKDNIQYKNLTLKEWIKSLLAFKEIVKNEGFNLISFDQFFKVLQKHGIPTSKNRIVLENFTFRSNSKDLYNNPILRFSNNQILIFPLTMLYPDIITILNSILSENNLAIKDKGYDFENYVFNYLLEKSAHLDNFNVTQPKFKNKDGEFQYDVLIEWENYIFIIECKNRSIPNTTAMSLKDFREKSNEYIKQILRLKEGLLNHPRQHNINLNNKIIVPILLNSLPFSLDYSISDIYFLDLSCFSAFFNNKNLYLQSSFQGKIQKERIVHTNWSSDKPSVDDFLNFIKSPFHVSQLKSCLREHITFHTIGNYEIALERKYFDLHSEEYEKILEVKKNMH

SEQ ID NO: 6587 - protein, 496 aa, Acinetobacter baumannii
MNSKVNTKLLEMQLERELCEKEHLFFTRRFFLPRMGFKFSVNWHHEYIADKIDEVIAGKVKNLVINVPPGSGKTELLTNLIARGIARNARSRFLYLSFSQSLVEDVSATARNIVKSEDFQNLWPVKISTSTDAKSSWKTTVDGYDAGHVYSASMGGQVTGRRAGTLANEGFTGAIILDDPLKPEDAFSQTARRKAKSDTPIILIMQRLHVEDPTNFVLTGNVPGEWEQISIPALIDDEYISKLPEHIQRKIPRDVERDEKGRQSYWPLKESLLSLLQLEKGGEDKDGATVSRYTFASQYMQNPKKLGGDLVKAEWFGRYEELPLLKWRAIWADTAQKTKEHNDFSVFLCAGLGYDNNLYIIDVKRGKWEAPELLKEAKAFINKHKDSNTKIGKLRYMAVEDKSSGTGLIQSISRQTTLPIRAIQRDTDKLTRTMDVVFYVEERRVWLPAEAPWLLNYIEEIEGLTADMSHDHDDQWDPTIDAINDSLAKKPTVFDD

SEQ ID NO: 6588 - protein, 93 aa, Acinetobacter baumannii
SMSNVGNIHRESKNCSLVAKIVMILGVIWGIAFIVAFGQVETRNEYLEIINVWSTKMIVIGCLIILNGLGLGYLILKISCILRNQEILLNEKR

SEQ ID NO: 6589 - protein, 174 aa, Acinetobacter baumannii
LMSNLEQKLSQYAAYHLNHQNILTHFIGIPLIVFSILCLTARAGIDIGNFKVTLAMVLIAASTIYYLFLDKVFGLIMLMILVAVYPLASQIAELSLGQWLAASIGFFVVGWAFQFVGHYFEKKKPAFVDDVIGLAIGPLFVLAEFIFMLGFRKPLHERILHEARSKREMMDLSH

SEQ ID NO: 6590 - protein, 164 aa, Acinetobacter baumannii
SMSKQLEQMKIRLSAVAHGVQIAVGDAFNLDNFAKLLLKLESIDEMTPQLAEAQAYAKYLPIEGLEGAVIGSASVLQRKKGVGRGKRFSGQGNDVPLAEVMYDSQASNGYQGGNEEPGNVNAPSIFEPPLDLTDGKNKYGLLFLVGLIGAAVTSGLALIIRPMK

SEQ ID NO: 6591 - protein, 488 aa, Acinetobacter baumannii
VSTKELDHNHRYEIKSPDDVSQLISKFAGKGKSNKVIWLALIGVFIDAYDLTTLSFGIEQVISEFSLSPVMTGVVASAIVRGTIVGNLIGGWLTDKIGRYRVFMADMVLFVIAAIVAGFAPNVWVLILARFIMGISVGIDLPVAMSYLSEFSKFNGSSNKAARLAAWCPMWYAASSVCFGLVLALYFLLPPEHSNWLWRASLIFGAVPALLIIFIRGKYLTESPIWLANQGDLKGAAQVLQESYAIHAVATVEKVERTAEKKKREGFTVLFNKTYLPRTIVAIVIHISVAFQYTTIAFFLPSILTRFFHTDVLTTITTTLGLNLLFAFTGGLLGVFVASRFKSRHVLLTGFLLQFIALIALAFIGEPGNSFLLYTAIGMLGLWLFAEGFGPGAQMMVYPTMAYPASIRGVGVGFNRAVTGVAQAIALFVLPIWMAGYKTDVYLIISIFAFIPLIVIGLLIKFEPTAQDVDVIDEDKTELPLNNSPVID

SEQ ID NO: 6592 - protein, 520 aa, Acinetobacter baumannii
TITNKINKISMIGYNQRRVRGICRKQAFLKGLMLLSTLHVPVVIYAAKPSEQYHTLKENLSQLFVPKSSDDFKVAKMHKLSNFKLDRSIVQEFPTVQLNDNRASSFSNLPSRTMTLQDAVKIAIQRSPDISQSIATLAGQNSGVDVAKAGYYPQLSGGITTGDLSSGERGRQLLTLSATQMLYDFGKVKSGVDVEEAKVQVEQANVLVSVDTLALDVAQTIVNIQRYLQLNKIAEQQIAGIRRIQEIANLRANAGVASQADPIQAQSYLQAAQSALIAQQSLLRQYQQHLRTLLGADVSHTGWIISDDLVKQSDLYGEPEFNTIPKMIAAQAGVEVAKAQKQQTRLTRYPTLAVKGSVSQAINGKNPNNDKDDGLYSSVMLEATSQFYQGGATASQVKMASYAEEAAKAKVNSVYMDVLDQIRTSREQIENKQRQMQVLASRQATTVRTRELYQEQYKLGTRSLVDLLNAEQAIHSANSELESARYDIYSSIVQYIEATGRSRQAYGLNNISIQGFEVQP

SEQ ID NO: 6593 - protein, 160 aa, Acinetobacter baumannii
MKANQEFLRQAIELAYNNIEKGGRPFGAVIVKDGKVIASGVNQILTTNDPTAHAELLAIRAASQVLGNANLEGCSVFASGHPCPMCMAAMRLAGIKTVNYAYSNEDGAPFGLSTAEIYADLVKPFAEQSMKIEYVPVRFEDRTDLYVFWKNYQAKQSGLK

SEQ ID NO: 6594 - protein, 191 aa, Acinetobacter baumannii
TMQNKSNDNAPRHFNLTARILHWLMAAAILAMLFIGVGMTTSMTWRPWLIDIHRPLGIAILLLVVIRLINRLCYPIPPLPPTVPRWQAFLAHASHWLLYILMFSLPLLGWAMLSAGNWPVTLFPGWDLPPIAPTNSTLYAWFRTLHGILAWLLFAVVIGHLSAALLHAWIYRDGVFSSMALGPSSKKEEAD

SEQ ID NO: 6595 - protein, 121 aa, Acinetobacter baumannii
NIKNEREENLAMCDIDNLNGKFVKYDQLYSINIYFDDFDGVYNLDMVLAKDLSDIYSEKIKIRFFNITNLCLNDVGNRFTQFCRMYIEKNLDGWDGVKYNLNQLEEDRILFKFFNFELLEE

SEQ ID NO: 6596 - protein, 155 aa, Acinetobacter baumannii
KIKKLKIIFKGRIMEISLRFATPADLKAINERYAEIDFVASHDDELIVLASIDEKTVGQGRVVGIDANSGELGGIYVFPGNEGLGIARKVVDFLIKNSDFSMLYCLPFAELEGFYGSMGFAAVKDMAQVPEAVLKKHEWCNSNYDKPVLLLERNK

SEQ ID NO: 6597 - protein, 235 aa, Acinetobacter baumannii
AVKKSKIYKNITYFLIMAIQRQKLELPSGHNKLLLHSCCAPCSGEVMESLIESNINFSIFFYNPNIHPVKEYLIRKEENIRFAEKHNIPFIDADYDTDNWFARAKGMENEPERGIRCTMCFDMRFERTALYAYEHGFSLISSSLGISRWKNMAQINDCGIRAASHYPDIQYWDYNWRKNGGSSRMIEISKREEFYQQEYCGCVYSLRDTNRWRMSNGRDRIKIGVKFYSNVMEND

SEQ ID NO: 6598 - protein, 263 aa, Acinetobacter baumannii
SNKNKRGDFMRVLYQFPLSHYCEKARWLLDHKELDYVAHNLIPGFHRAFAQLKTGQNLLPILKDDHRWIAESTKIALYLDDTYPEHALLRRDEQLRQQTLKIDSLADELGVHVRRWALAHTLAQGDHALEIMMGEQGYLRQFEKISKPFLKTLVKKNYKLEEELVSQSKGRMDELINELNHYLIENQARYMVGDRLSLADISVCSMLAPLLEIKGTPWEREEDGEVSPDWSNYQKYLLDLPLGQYVLRIYQTERNARVDWRGI

SEQ ID NO: 6599 - protein, 62 aa, Acinetobacter baumannii
WLKNHLFHFIIYNQQITFITPAFPYSYPQDLRITICKSHHLATSNGTVALRKIVVAILPKKN

SEQ ID NO: 6600 - protein, 439 aa, Acinetobacter baumannii
KSKKVLCIFIHKLSISPRLVEKYFFCKVMTVIQGVIMSNSLSKTTAYVQVIQNDQQAINAAYQVADFALEGRNTRDQQRLLPHEQIESFSQKGLGGIRIAKKYGGAFVSNKTLAQVFRILSKGDANVGQIPQNQISLLNLIEIMGTEQQKQFIFSEILAGKRLANGGPERNTHDSKTLKTTLTIENGKYFLNGEKFYSTGTSFAHWLAIKAIHPEGHVVLVIVNRDAQGIEVINDWNGFGQRTTASGTVKLNQVEVNPKLIFDERLLTQVPTYRGAYSQLLQVAIDVGIAEAAFEDTLSTIHKARPIIDANVEKASFEHYTLQEVGKLNILLDAAILLLDEAAEYLDELDQLQTVTDEQVAKASILVAEAKVYANDAALQISEKLLELGGSRSSLSQHNLDQHWRNARVHTLHDPVRWKLHAIGNYYLNGHFPARHAWI

SEQ ID NO: 6601 - protein, 63 aa, Acinetobacter baumannii
IRKKAFKIYLIHQFYSFYLCFLYVFLDEKNFRIKTILFYVYRIRYMKNDWTAIDTHSITFEMD

SEQ ID NO: 6602 - protein, 427 aa, Acinetobacter baumannii
KMKKTPLWVGVCLCPLFSQVVHAEFIADSKAELTLRNFYFDRDYKKDPYPYTAARDWAQGLIFKGQSGYTEGTVGFGVDVLAMAGFNLMGSRADDYARSGLLPVNTDNSRDDYYGKIGITGKAKFRKNELFVGDLVPQLPTIFSSPARLFPQSYRGIRFVSNEIPNLQLEGFYVDEVRQRDSIRYTDVGTDNINHRFNKAATTDSFYTLGGSYQLKDYRLRAYHAELKDIYQQQFLGFNGKQPLNDQLNFLSDVRFFNSEETGSKKIGEVDNRHISGLFGLNYQNHTVSLGYMQSFGSTGLPFLSGTESPVVLDFMSSDYSNKDEKVYSIRYEYDFKNARIGDVSLNGLRFMTRYAKGEDIDLLQYGDQRFKEDSLEFDLGYKIPEGKLKGLGMRARFSHYRNDMPTNMTFHSANETRLNVDYTFKF

SEQ ID NO: 6603 - protein, 439 aa, Acinetobacter baumannii
KMKKLILAAACAAASGTIFANSSDTTEQRINLLETELQKLKAELAAQKQTQNNLQVKQVKIEENIEKTKATVTEKPVAPSWVTWTDNVKVYGIARIDAAVDFKSSPDSGGRTTSSLYRTPFESEKRSNHARSDAMINASRLGVYFNSPNKAVTGNIEADFFDSSNMGTGDGKFRIRHAFFTYKDWTFGQTWSLMSNMETRTEAVDYTQFVGTSYTRTPQIRYDWKIDANNDLKVALEYTGSRVSAFPTLTGRYTFKQGPLTALAQGFINEKSTDVATATVKKVSWGAGGGLKYQLTPQQSVQANYQYIVGDQKFMPYTTQSGLANSTNLNAAGDFSLNEDKTDLVMNKLNSINIGYSYKFNEQWRANLSASMFDYDDDTAYAKLNPDANKRLTDYAANVFYSPIEQMDIGMEYHQGKREVFDGRTADVSRVNFVSMYKF

SEQ ID NO: 6604 - protein, 1627 aa, Acinetobacter baumannii
FEKNMSQNSVVAPLNTFSPKDLTAKKAEVDKWFREYTNGVVTVDRLETICRSVPVLGSAFAIGDIIIDIISMINKGGLDKVEIFDWLNLGIDVIGLVPMGPVGPSVRSAARPALFYVKNESEKIIKAQAKKLGKKTLTSQEVKKALSTGFKDSASVFLTTIIAENVAGTLENFAKKGQSLLNQILKEVGNWIVLLTKTIDDGFKKLVSGSLNGLPNLKRAGQQSLGVIKGIFELDGTRIVNNAKYATENVAKTVGKGYVNLANLAVSDEARAKVLALGAKIRSIGQVAQAKVNGLSDPNTLWTIGWLFSIMGMVAAKHRQKRAQIKAKETTKANASHPSTATDKSNKQAHAENNANQCKNCMGGTGGSITFAMGTEFFTHVDAQLGGIIQDSISRTYVSNLYQMDDAIFGARWVTPFTTKISRKFKYTSKKKDHKDYLNGLEYICLDGRAIDLPDLKKGQSIYDPIEQYTYTVLSDQLHLIAYGEDEKRYYEKYGEDYRLSYIERKNGFKVALRYDHVSTDNKTILSDILFKQDDNLLAHLALQLTPQGLVSDIWTIKNGQLDRVLASYDYDQQGDLVQATNEFAASYYYQYTHHLITRYTDLTHRGMNLKWDGILPTSKAIEEWADNASRASKLEWDKNIRKTTVLDVEGNSTEHYYDIDGYTYRIVYPDNFEECFFRDDAKNITLHIAKDGSKTSYTYDERGNVLTTTQDDGATSYFEYDEKNQLTGMVDAEQGRWFKQYDGSGNLIKEIDPLKHETAYVYNAMGLVTSITDAKGGSKSLKYDDQGNLISYTDCSGKETKWQYDERGRVISIENALNQKVEYFYTELTLENREPIIKGLPLNAFGQLEKIKHADGTEEHFIHDAEGRLLAHVDPKQNITRYEYDEAGLILSRTDALNHKLKYKWDRLGRLTRLINENGASYQFFYDVASRLVKEIDFDGKETVYHYDEKSGQLATSIEVASAYGQDLKDRAAPKDRIQQFIFDSMGRLEQRTAGYGHYGLELEEKQTEEFAYDYMGRIIQAKNAQSNLQWFYDAAGNLVQEHQQDYKINKTAVWKHQYDEINDRIKTTRPDGQVIDWLTYGSGHVQSLIVNGQDFVSFERDDLHREIARHYANGVSQEQQYDLAGRLKSQMMLSEHENGYQNQYKRHNNALEQTSQLVQRLYQYDKTGELTAIRDTRRGNIAYKYDPVGRLLEASSKLGKETFSFDPASNILDSYHSQKVQSHSQKLDETSYGYNRLVNNVVKEYLDQQYQYDAYGQLIRQKTSQGDLNLEWDVYGRMVKSRNSQYTAEYRYDALGRRIQKWSKHHHTGQEQNIIYGWDGDTLAYESTEELTKHYIYEKDSFVPMLQAVYLSPIELHQTPDWSDRPYNIHRDPLWKTEKEGKEFDDVWFYHCDHLGTPQEMTDHTGAIIWKAEYKAWGECKAEEAKSNFFENSEIISNNIRFQGQYFDEETGLHYNRYRYYSPYVGRFVSKDPIGLLGGNNVYVYAKNPITWIDSKGLCSTTLNRNLGGVKGDHLQAHHIIPEEIWAKRKDFLDDIGIGGNRDKAENGVLMPDSEAKAKQMKRQLYHCGSHPIYSAGINQKLGQIQREFESKKITASQARDKVANLQSSMRLVLITPGTKPIRLS

SEQ ID NO: 6605 - protein, 548 aa, Acinetobacter baumannii
LTENDWEIDVMSVSEHPNLDTVQGADSQKAVNETLEDYTLRYAPHSFRRWSPKVVAITALGGIAYLADFSIGASIGMSYGTTNAVFSILFAAIIIFLTGIPLAYYAARYNIDLDLITRGAGFGYIGSVLTSIIFASFTFIFFALEGSIMAQGLLLGLGIPLWAGYLISTVMVIPLVIYGMKALSKLQVWTTPLWLVLMIGPVAYLIYQEPTLVSQFATFTGHEGFAPVDMAAIMLGAGICLSLIMQIGEQIDYLRFMPAKTKENSKAWWAAVISAGPGWVILGAIKQIIGAFLGFYLLTKIPGVNSTEPVQQFNAAFHDMLPGWAALTLAVILVVISQIKINVTNAYSGSLAWTSAYTRISKHYPGRIVFVIVNLAIALALMEGNMFAVLGKILGFYSNFAIAWVVVVATDISINKYVLKLSPKEPEYRRDMLYNVNPVGMVAFLVSAGLSIAAFFGLLGSFLAPYSPIIALVLAFVLTPIMGLLTKGKYYIKSHDDGVKEPRYDAEGTPVATVYHCRVCEQGYERPDIMFSHKHNGTICSLCKTLDA

SEQ ID NO: 6606 - protein, 64 aa, Acinetobacter baumannii
ELEKGLLLLLRRSVQKLKIKMRLQMPYLVWSLSQSSSLLLGGMIEILILYNQYISSIFHGKTIK

SEQ ID NO: 6607 - protein, 130 aa, Acinetobacter baumannii
IMENFLTSNGLAAAFNLYGTVMMVALAVSLVVAVVLIMRFPRSPQEWVVGLICTVVSSLTGGSFIIMKWNLHEWVTDIWGMITLGGFFFICGLPGWAIVRWIFNFINKQEGKTIVEVMQDLKKAKDDIQS

SEQ ID NO: 6608 - protein, 200 aa, Acinetobacter baumannii
RIRKMHLKTLSFGLAVALASTVTLAAPVDYKIDPTHTATVFSWNHFGFSTPSANFSDIQGVIKVDNAKPANSSVNVTIPLSSVNTNVPALDKEFQEEAWFNAAKYPNITFKSTKVETKDKKHFKITGDLTVKGITKPVVLDAVLNKQGEHPMAKVPAIGFNATTSFNRSDFGLGNYVPNVGDKITVNITTEATAASAAKK

SEQ ID NO: 6609 - protein, 203 aa, Acinetobacter baumannii
KKRKMISKANSYLALIKTRTTLMNIEQYLDALIKREGGYVNDPLDHGHATKFGITQAIARSYGYQGAMENLTLETAREIYRNQYWLEPRFDQVNLISTLVAEELFDTGVNCGISFTKPLLQRALNLLNRQGKEGWVDLKVDGEYGPATLQALIKYIKNRGKEGEKVLVRLLNIMQGQRYIEITETNPKHEQFFYGWLANRISL

SEQ ID NO: 6610 - protein, 71 aa, Acinetobacter baumannii
FRRNNISDSLSDHFRHPIKFVKYKAASNQTVKVVFGLFLAIFNCSRTKICSNTSALPCFMNLSIVKFTKSD

SEQ ID NO: 6611 - protein, 171 aa, Acinetobacter baumannii
SGRNSMSTQDKATLENIAQFLYREARFLDDEQWDDWLECYAPEASFWMPAWDDDDRLTEDPQSEISLIYYPDRQGLEDRVFRIKTERSSATMPDTRTSHNIANVEVLDRDGDKVTVRFNWNTLSFRYKTNYSYFGMSRYVIDFSGDQPKILSKYVVLKNDYINQVIDIYHL

SEQ ID NO: 6612 - protein, 324 aa, Acinetobacter baumannii
RYGNLMELRHLRYFVAVVEEQSFTKAAEKLFIAQPPLSRQIQNLESELGIQLFERGSRPLQTTPAGHFFYQHAVKLLSNAEEIKSMTKRIGLIERSMTIGFVGSLLYGLLPRIIYLFRQQQPHLNIQLMELSTTEQLQALKEGRIDVGFGRLRISDPAVRRILLRKERLVVAAHTSHPIAQRTEGVYLADLIDEKMFMYPTSPKPNFSTQLLNIFAEHSLVPKNMHEIREIQLALGLVAAGEGICIIPASADTIRFPHLNYIPILDNGAVSPIFITARAMDRSEDLQSLFDCIYQVYDLEGIPYQRTVFTLDQNPIDDSNGIDF

SEQ ID NO: 6613 - protein, 260 aa, Acinetobacter baumannii
NPLKSAHAFRQNGYHKWLKVTSYLCFYPKQPMCNLACLLQILKVLKLLKPVGCKEVAVFTAVSESFTRKNINCSMDESFEKFSDVMAAAKAHNIRVRGYVSCIVDCPYEGAIAPEQVVKVVKRLYDMGCYEVSLGETIGTATPDRVQKVWQACLAELDSKVLAGHFHNTYGMAIANIYQSLQQGIRVFDSSLAGLGGCPYAKGASGNVSTEDLFYLLSHMGFETGINLEKLMQASQNISNVLNRKSLSNYANAYWQTKCA

SEQ ID NO: 6614 - protein, 424 aa, Acinetobacter baumannii
MNLNIRGHLMKNFLTKKMYATRALFFAVGVTALNVSPIVISTTHAATEQKMDNLSTTLSLIFADKPIEASLFSPQFLGQVPITQIQKIVDNLKVSLGALKNINVSNGSGTIDFEKGELPVSISLNEQEQISTLWFSAPHFKTISLDEMVKGLHENAIGKTSLLVIVDNKPVVVENDKTPMAVGSTFKLLVLKAYEDAIKKGELKRETIVSLKEKNRSLPTGVLQNLPAGTPINLELLAQLMIQISDNTATDSLIDVLKKPRIEALSPRNSPLLTTRELFQLIDSSNEKLRNKFKTGTKSARLEALSELDKLPLPSVSSIGKSATWQDAEWYMSAHEICPLLESVQDAPALNSSLNPLFKNLNWQKIGFKGGSEYGVINFSVIGKTQKGHNVCAVFTANGNEPQPESKLAILFTGILQAVDSMSH

SEQ ID NO: 6615 - protein, 222 aa, Acinetobacter baumannii
LFMNLKIENPPVTLRELCLDKVRNAIITGYFPSGKRLVERTLCEELGVSRSVVREVIRYLEAEGLVEILPNKGPIVSLLNWDIASQIYEIRLLLEQSAVVDCTKNLDEKTAEKLKLLLEDLKAAFAADDINLIIATSTQLYQTIFTTANHHIAWEVVQRLNGRISRLRAMTMKSTKREISGYQRIKNMCEAIYLHKDPEKAKQAVAEHIAEAAAVAKNILDA

SEQ ID NO: 6616 - protein, 224 aa, Acinetobacter baumannii
INMKYFVLSATQSSLCPISLVDDAVLYMNKEQASQNIECGSLPWYSYKTSKNCDLPIEGVLILKSKKIEISIRNINENIYVVDEIFKNIFGKYINSDFIRVEVLSESLEKINNKNYYIFRFNQIFDFKNVLDLNKSTYRLDNDFLVLEKAEFLSDLDIDILKIDNMDSAQDTFFISEFVKKEIEKNKYQGINIFELTLAQWRDSDDFSFMFLSEDEVNKFVWPI

SEQ ID NO: 6617 - protein, 68 aa, Acinetobacter baumannii
WSMNMKLLIENMTCGGCARGVTATIQDIDPNAKVDVDLATKIVTVESSESVDKITEALEEDGFPAKVQ

SEQ ID NO: 6618 - protein, 318 aa, Acinetobacter baumannii
RSMNMDVIIQKIHQLTSTIRAFELVAANGTELPSFEAGAHIDVHLKNGLTRQYSLSNCCTEKHRYVIGVLHDANSRGGSRCIHTEYREGDLLKIGEPRNLFEIHPHTKQAVLFAGGIGITPILSMAYRLKSANIPFELHYFVRSHEMIAFYGNLTEHFSDQIHFHIQDQPDTECNMVEALGQASPDKHLYVCGPTGFMQFVMNAAEQAGWHSEQLHQEHFVAQKADTSNDEAFTIEVKGTGRRIEVLPEQTATEALIANGFDIPVSCEQGICGTCITRVVEGTPDHRDLFMTDEEHALNDQFTPCCSRAKTKHLVIEL

SEQ ID NO: 6619 - protein, 261 aa, Acinetobacter baumannii
VGMKISLLGSGRVAFHLAKALLAKGHNIVQVYARDFEKTKKFAEQIQAKACQSLQEFQPSDLIILAVSDSAITELATQVHELFPEMLMVHTSGSTDIQVISQVHEKAGVFYPLQTFSLERDVDWQATPLFVEATNKDDLAILSDLANSLSKQVYQYTSKQRLTLHLAAVFACNFSNYCFDMAKQVVDAEQVDFGLLYPLILETAKKATENDPKQMQTGPAMRGDQNILVMHQSLLAQANRDDLKQVYQLLSDGIVKRHHSS

SEQ ID NO: 6620 - protein, 142 aa, Acinetobacter baumannii
ILMNQLELILKTFHEYEFKEGLDDLFYLSGNFLKEIYPTIMLEYDQDTAFFMALKTLLESGDISLFYNLNFEDSSRDGELLTGSAEEQIKQLKKVWIGSDAINKMDEENNYIGWYFLIQCPYALAHKIYDKDGNFEHWFCTG

SEQ ID NO: 6621 - protein, 257 aa, Acinetobacter baumannii
ITMNQKYQIKLSQLIKGCFIYTIANYALAQPIVVEGIVPNEASKQAILMKMQSVYGADQVVDKIQVRPVAAPNGWSDSVTRVITPDLKKVSQGKLSVNGTRFELTGKMLNPTEIQPTIQSFQSLVQPPYQLFSQLSVNQAEQKIIDDALKNRIIEFESGSAILTEAGQKILDEMAVALNKVGGKKVKIVGHTDSSGDATKNLKLSQDRALAVKNYLISKNIPADHLSTEGLGSSKPVADNTSAEGRKKNRRIEFTVL

SEQ ID NO: 6622 - protein, 66 aa, Acinetobacter baumannii
FQMNDKELTFKEGHDILKRNAELLESQESPDIDNLMKIVEESIGAYKACKSRIEAVQQALDETFKE

SEQ ID NO: 6623 - protein, 160 aa, Acinetobacter baumannii
TRMNLDRLYPYGFRSTLFDRLIPESEDYAKGLSIQQLRESVAKDLEDLLNSRVAKLDHVIDDYPLVKKSILQFGIIDFVGLSTANPLDRDKICQSIEQSIAAHEPRLRQIRVEMLLDGHNMGALCLSIQAYLNIHPLYEPVVFDALLKPTTQQYVISART

SEQ ID NO: 6624 - protein, 62 aa, Acinetobacter baumannii
NLMNTVQHLYRTKLYFAVFYKIHTNLSISLAVNFKCKRHFLSVHKQYFRNLNIIKIMFNFIY

SEQ ID NO: 6625 - protein, 77 aa, Acinetobacter baumannii
MIVNIVNEWQIATAVNGNEINVRIVPHVRKQNSLDGYRWVEVGKKIQLQTGEEIELNQDGKSFYAGFNQLYRLNTYC

SEQ ID NO: 6626 - protein, 893 aa, Acinetobacter baumannii
PNSKIWSDLVVSTRLMTSAEIREAFLRYFETQGHTRVASSSLVPANDPTLLFTNAGMNQFKDCFLGLEKRDYVRATTSQKCVRAGGKHNDLDNVGYTARHHTFFEMLGNFSFGDYFKRDALKFAWEFLTSEQWLALPKDKLYVTVYHTDDEAYDIWNKEIGLAPERIIRIGDNKGEKYASDNFWAMGDTGPCGPCSEIFFDHGEHIWGGLPGSPEEDGDRFIEIWNNVFMQFNRTADGVLHPLPAPSVDTGMGLERISAVLQHVNSNYDIDLFQHLLKAAANIIGIEDEGQPSLRVVADHARSCCFLIADGVNPSNEGRGYVLRRIIRRAVRHGNKLGATGTFFYKMLQPLIEVMGQAYPELEARREVIEATLIREEEQFAKTLEQGLKLLEGELAQLKDKTIPGATVFKLYDTYGFPTDLTADIARERGFIIDEAGFEIEMAAQRQRARDAGKFAVDYNNIVKVEGETQFDGYTNTTGQGQIVAIYKDGVQVDEVSEGDEALIVLNQTPFYAESGGQIGDTGIFKNETGIFEVQDTKKSGGAFVHQGIVTVGNLKTSQNVEAIVKADIREATARNHSATHLLHAALRQILGSHVQQKGSLVASDILRFDFANDQPVSFEQLQQVERLVNAEIIANTAVTTELLDIETAKAKGAMMLFGEKYGDEVRVLSMGSVIDEKNFSIELCGGIHVKRTGDIGLFKITSEGGVAAGVRRIEAVTGTKALEVVQKADHDIQYINSLLKAQKDQTVERVQANVELVSALQKQIEQLNQKLANFQAADLIDQVQTIAGRQTLITTVQGVDAKALRNLHDSVKSKLENAVIVLAGVEGDKVSLLASVASQYTANLKAGDIIKHLATELGGKGGGKPDLAQGGAPLNEKFGQVMAALPAWLEQK

SEQ ID NO: 6627 - protein, 190 aa, Acinetobacter baumannii
KVTKMNHVEIAVQKDTVPTCTELFLGFLTLGLIGFGGVLPLARKVIVEQRHWLSPEKFTELLGLCQFLPGGNIINLSVAIGMEFRGVRGAVSSLIGLIFAPTVIVVLLHYVYEQFQDNLMVKHLFEGLGAAAAGLLVATGLKMLKPLLRNPLAICVVVAAIISIAFLKIPLFLTMLILLAFYSAIIWRRV

SEQ ID NO: 6628 - protein, 311 aa, Acinetobacter baumannii
FMAKNKDKAQLALGDHAARQLANATKTAPQLSTITPRWLTHLLQWIPVEAGIYRLNRVNNTDDIQVACTQRDEATLPQTFVDYDPEPREYFLNGVSTVLDVHTRVADLYSSPHDQIKEQLRLTIETIKERQESELINNPEYGLLASVTDDQRISTLNGPPTPDDLDDLLRKVWKEPGFFLAHPDAIAAFGRECTRRGVPPPTVSLFGSQFITWRGIPLIPSNKIPVEDGKTKILLLRVGEKRQGIVGLFQPGLAGEQSPGLSVRFMGINRNAIASYLISLYCSLAVLTDDALAVLDDVEVDKYHDYPVNYK

SEQ ID NO: 6629 - protein, 190 aa, Acinetobacter baumannii
FIEKKMIDFVKELSACRVEGTKLPFYPEKVQGYTEKEVELIAKNLNLDIHGQFREFLLQMGRCSGGLIWSDEFYMYKNLWNPNKFRHAQQSEKEDLGYILTSKGKLDPVDMKMFYLSREYETYFYYLLTAENDDFIWSLHDADDCVLEKTNITLLEYLKDYVFEKNKRNRFVDFGLTEEQINRSITGRLL

SEQ ID NO: 6630 - protein, 267 aa, Acinetobacter baumannii
QVEKLSMSNRQRFTDKVVIVTGSAQGIGRGVALQVAAEGGQVIMADRSEYVQEVLTEIQRAGGEAVTINADLETYAGAQAVVAKAIEHYGRVDVLINNVGGAIWMKPFEEFSEEEIIKEVNRSLFPTLWCCRAVLPAMIKQQSGVIVNVSSIATRGINRIPYSASKGGVNALTASLAFEHAKDGIRVNAVATGGTEAPPRKVPRNANPLSQNEKDWMQQVVDQTKDRTFMGRYGTIQEQVNAILFLASDEASYMTGSVIPVGGGDQG

SEQ ID NO: 6631 - protein, 305 aa, Acinetobacter baumannii
IVWNIIYFAVFLVESKPSQAANGKKHHRTRRINPMLKQLKEDIQAVFARDPAARNTLEVLTTYPGIHALLLHRLAHELWKKDCKGTARFVSSFSRFATGIEIHPGAKIGKRFFIDHGMGVVIGETAEIGDDVTLYHGVTLGGTTWNKGKRHPTLEDGVVVGAGAKILGPFTVGKGAKVGSNAVVTKAVPAGVTAVGNPARYIYKDADKTKDKDEERRRDYAQSIGFAPYATTADQSDPILEGMRVLLDRIQHNETRMNNLCQRLSELDPTFKKESQDEQPFSDEELKILEEVRRECGAQNKTSKT

SEQ ID NO: 6632 - protein, 139 aa, Acinetobacter baumannii
HLRNTRTSRETFVQKMETTAVDQFAELLGVQVLHRSFDEARCKLNVKDEHMNALGGVHGGVIFSLADIAFAMACNAGDAPYTGLQADIRYMSGAKDKVLFATATKVGSSKKFAHYEVLITDGLNNRVALFTSTCYRLAP

SEQ ID NO: 6633 - protein, 274 aa, Acinetobacter baumannii
SIRKSAMYKDIKVDPAQLEAALDARLKIRAGFDKPTAGMAAGMTQVNMISVPKEWAYDFLLYAHRNPQSCPVLDVLEEGIYATKLAADSDIRTDFPRYRIWKDGEMVDEVTDAREIYNAHPDLVTFLIGCSFSFETALQEAGIEVRHIHDDTNVPMYLSNIKCEPAGRISGNMVVSMRPIPSHQISEAVKITARMPSVHGAPVHIGHPERLGIKDVNKPDFGDASRIEAGEIPVFWACGVTPQAAVMNSKIPFAISHAPGYMFITDIPDRAWIG

SEQ ID NO: 6634 - protein, 121 aa, Acinetobacter baumannii
KKRNFKVMNENAELIKYIDVAESVYERVYENNQISNSLVVNLNRVMDEIKKQAKEKNLKLKYPSIDFEYCLSLPLADRDVKVDLSLIPHFEYRDECILWLTNFIGKISVPQKMNRQRLNSR

SEQ ID NO: 6635 - protein, 120 aa, Acinetobacter baumannii
IRRKNTMNKLLVALGLAATVALVGCNKDKAPETGATTGEHLENAAQQATADIKSAGDQAASDIATATDNASAKIDAATDHAADATAKAAAETEATARKATADTAQAVENAAADVKKDAQH

SEQ ID NO: 6636 - protein, 100 aa, Acinetobacter baumannii
VIGKYDMSAYWIAHVTIHDMEQYKQYMATAPQAFQKYGAKFLARGGASEVLEGQEFERHVVIEFPDMETARECYFSPEYQLAKSKRQGCCDVMVSFVEGI

SEQ ID NO: 6637 - protein, 891 aa, Acinetobacter baumannii
IFRFFKGLLRMNSAEIMADLSNHTPMMQQYLKVKKDYQHALLFYRMGDFYELFFEDAHLAAKLLGITLTHRGKANGNPIPMAGVPYHSAEGYLARLVKAGRTVAICEQVGEVTGKGPVERKVVRILTPGTLTDDALLTSYQSSNLVALCIHQNQIGFALLDLSAGIFKVQQQDYKPEQLPIELARLMPSEILIDEDLVDPNIIEQIKKHLDCPVTKRPNVDFNLNNAQKTLCDQFSVSTLSGFGLDPLPLAKAAAAALIHYAKETQKTALPHIRSILLEQSSDFIALDPITRRNLEIIEPLFEHGTSLFQLVNDCQTAMGGRLLSRTLMQPVRDTALLDARLDAIEQLIQGYHESPVRLVLKEIGDIERVLSRVALGSARPRDLVQLRHACAQIPFLRNALAPVVQAKKSKLLGQLDQELGDFKALHQHLMAAIVENPPVLLRDGNVIAEGYDAELDELRQIRDHAGQFLIDLEIKERERTGISTLKIGYNRVSGYYIELTRAQAEQAPADYIRRQTLKNAERYITPELKSFEDKVLSSESRALAREKALFEALLENLRENIAHLQMMSSAIAQIDVIANFAHQARLNNWARPEFTPETGIKIQGGRHPVVEALSKAPFTPNDTFLDVQHRMAIITGPNMGGKSTFMRQTALISLLAYCGSYVPARAAKLGPIDRIFTRIGSADDLSTGKSTFMVEMTETSQILHHATNQSLVLMDEVGRGTSTYDGLSLAWACVVDLTKRVKCLCLFATHYFELTELGSEPGIDNYHVTAQELNGNLILLHKVQQGPASQSHGLQVAKLAGIPANVIKEAQKRLRILEKQQQQHLQTSVQSDLFATLDSEVTPSTQVIEKVIEVEVSSPALDLLKQIEVDNLTPRQALEQLYELKAALNS

SEQ ID NO: 6638 - protein, 247 aa, Acinetobacter baumannii
LMLFRGRKFFWGMACLQALIATTGHAEIVLHGTRVIYPSDAREVNLQLSNNGTAPSLVQAWIDDGNAKSTPDEANVPFIITPPISRVEPSKGQTLRITALPNASQLNQNKESVFWLNVLDIPPRPEGKKQENNEVLTNNFLQLAIRSRIKFFYRPVSLKENINTLSEKIQWVKNGENLLIKNPTPFYITISSIFQEINHQKTDLLKQGLMLSPFSEDQIKLKNSNITNMSFVYINDYGGRIEQVIRF

SEQ ID NO: 6639 - protein, 241 aa, Acinetobacter baumannii
IMFDMRLSHERGAAHHGWLQSKHTFSFANYWDPKQVGFSDLLVINDDTVAPSKGFGTHPHRNMEIISYVLEGALEHKDSMGTGSVIVPGDIQLMSAGRGVAHSEFNHSTQENVHFLQIWVVPNEVNTTPGYQQLHISEEDKRGKLHLMISPKGGEKTLSIKQDINIYSGLFDGEETAEFAIPEGRYVYLHVAKGRIDVNGKTFNTGDAARIRDGGKLSFTNGDNAEILIFDMRPEEIPTMP

SEQ ID NO: 6640 - protein, 416 aa, Acinetobacter baumannii
RVLEMKLYQATLFSLVLFTSFAQADAENSQWITTWSASPQKVWNKDFVFPTLIPEQVSNQTIRQKSKISLGGEAVRLVFTNQYGEQPLYIDQTTIGLANAATLKSKSTYPVYFSGQLKARILPGKQLISDPIQLPVPDHAQLVVNSFIQKPTTFKTFHWDAKQTSWLISGNQTTSLTTPTDAKTTTARLLLSAIEVKPKQKAHVVTVVGDSITDGATATLDANTRWTDFLAKRLSAHHVAVINSGISGNRLLTDGMGDRVLKRLNSEVFQYSGVKTLIVLVGINDISWPGTAFAPKQQIPSFEALTQGYRRVVSEAHKHNIQVIGATLLPFSGALPNTPLDNYYQPNKDQLRQRINHWMRTSHTFDGVLDLDEGLKDPKHPNRLNPIYDSGDHLHPNDRGNQHMAELVDLDQIIKN

SEQ ID NO: 6641 - protein, 364 aa, Acinetobacter baumannii
MSIDISELLKPINDSLLCGEDYSFSNEFHEIKKARTQDDLLLDQGDWVAERKQADWDFVAKSVSTLLIEKTKDIRLLTWVIEAWTHLNGFEGMVKGITLTHTMLNQYWQDIHPIIEDDDLDQRIGLLQGLINQLPMLLKKVPLTNTAPYYNLLDYDNFLYHENIRRKQTEEYESQSGPSELEQFDQAIFNTSKTFQYSNYQEFNSVLTEWNVLKQTLDHLMGLDSPSFAAIDSAFETIHSTLRKIYKAEAFGTGLAPSQEQAAVITTPSMENQVPVQIVSDQPMFQPQAQTHLANREQAMKVLQEIADYFQANEPHSPVSYMLQKTIKWSQMPLHEWLAQVIKDEHPLQMVQEMLGVQPKNEYE

SEQ ID NO: 6642 - protein, 292 aa, Acinetobacter baumannii
FISDVKICTMIDWENLHYFSVFSEEKTLSAAARKLGVDHATVARRIAQLEDNLKLKLVDRRPRTYILTSEGERLAKIVTRMMEETFSIERLAQAGQQEISGVVSVSLPPATAAHLVMPHLGKFYRQYPELQLRILGDVHYASLQHREADIAVRFGRPKDDYLIARKAGEVPFGIYAAQEYLDAIQEENYEWICVEVGGVQGQKQQKLKQRLNYKEPVMVTNHPELQWRATCGAVGLAVLPDFLGQQGHLVKLPDDDPMSAEIWLVIHEDLRSSPAVRVVMDFLLDCFESFRV

SEQ ID NO: 6643 - protein, 158 aa, Acinetobacter baumannii
LITDDRLGNPMANSKLMKDEPCPVARCVNLIGDRWSLLIVRDAFDGMRRFGDFQRSLGVARNILSDRLKKLVDAGVLELQDASDGTAYQEYVLTTKGESLFPVIVALRQWGEHNLFESGERHSVLIDKTTGQQIPFMSPVAADGTVLRASNTEVQKVK

SEQ ID NO: 6644 - protein, 204 aa, Acinetobacter baumannii
LMTDSLLKYREQHKHRLNYMPWLYWTLKPKHRVWAEEWQKEYQAYLMDMETVEIGENCFISPLAHIFAEPGRKIKIGDNCFIAADCSLHGPLEIGNEVAINHHCILDGGRAGIKLHDQVRIAAYCHLYAFDHGMQLDRPLYQQPVRSQGIEIEKDVWLGAHVGIKDGIKIGKHAVVGMNSMVTKDVEPYHIVGGNPAKFIRLRE

SEQ ID NO: 6645 - protein, 82 aa, Acinetobacter baumannii
VVYEGSMSFWQKLFLADQQHNEHKNQTACVENDCSCKTNEQLLSALAQATDEDVIKGIKKVLISRGYSRKELNELTQKPSIH

SEQ ID NO: 6646 - protein, 176 aa, Acinetobacter baumannii
KVYEMFDKLMTDQEIKAKLFERTSEIKKFGKLPQLDDNYLSFLGKYREIEITPDIIILGYETALKENQYLHENYPEISEKVWIIGRTGQGDEWFIGKEKNNILFYDHNQGEYLNINQFIDMRITFEDFLKMAFSYQQLEEKLDINEELNKVEQDQFKKLVNSINEGLYERYPFEYF

SEQ ID NO: 6647 - protein, 231 aa, Acinetobacter baumannii
ILDLIYINRLKENTWFSVLPEVFQKFILEHGKQITFEKNSYVFHAQDEFDGIYTVLEGSISLGYVDVNGNEALSAIAEPIMWFGEISLIDHEPRSHDAIALKKSIVLHIPAKPLNELLKEHPYYWYYFARLTSQKLRYVFLEQIAIQTRSISQRLAQRLLFILEGYGNHILIQDHHIQISQEQLANMLTISRQTINHELSLLEKQNIIKIAFRKIEILDIEKLKVIAQVHS

SEQ ID NO: 6648 - protein, 846 aa, Acinetobacter baumannii
PSHDGNLYAQYRILNFADLQRCLMDSKTTKLPAYSETLSIEGMTCASCVGRVEKALKKVENVEIANVNLATEKAVVYSNQPIQREALVKAVERAGYDVPKAAPVELSIEGMTCASCVARVEKALKKVEGVQNATVNLATEQAWVQADPSVNVEDLIRAVKKAGYDAKASEKNQDEQLDKKASELDQLKKDLIISIVLALPVFILEMGSHLIPAFHMWVMHTIGQYNSWLLQFVLTTLVLVFPGRRFYQKGIPALWRLAPDMNSLVAVGTLAAYSFSVVATFMPQVLPQGTVNVYFEAAAVIVSLILLGRYFEAKAKGRTSQAIQHLVGMQPKTARIQRDGQVVEVAVAEVVSGTIVEIRPGERVPVDGEVVEGHSYIDESMITGEPVPVEKRVGQQVVGGTVNQNGTLNIRATAVGSSSVLSQIIRMVEQAQGSKLPIQGLVDKVTMWFVPAVMLIAAITFLVWFIWGPEPALTFGLVNAVAVLIIACPCAMGLATPTSIMVGTGRGAELGVLFRKGEALQLLQEAQVVAVDKTGTLTEGKPTLTDFNVQSGFERNQVLTLVASVEAKSEHPIALAIVQAAESEGINLLPVTAFNSITGSGIEAEVSGHKVQIGADRYMHQLGLDTSSFQAIAAQLGEEGKTPLYVAIDQQLAAIIAVADPIKETTYAAIEALHQLGLKVAMITGDNRHTAQAIAKKLNIDEVVAEFLPEGKVDTVRQLQKQYGRLAFVGDGINDAPALAQADVGLAIGTGTDVAIEAADVVLMSGSLKGVPNAIALSKATMRNIRQNLFWAFVYNVALIPIAAGALYPAFGVLLSPMFAAGAMALSSVFVLGNALRLKRFHAPVQ

SEQ ID NO: 6649 - protein, 350 aa, Acinetobacter baumannii
KIDESNGTHMKITSARQDQGIPGVYGLLLLDVVSRWGYNDETLFAPFHLTSEQLADPEYRISTPVANELVKHALNLTGESTLGYHIGTQMRISIHGFIGYAIMTAKDITEAIALAARFIQLRLPFLQLYFSTFGPKATLQLQCDIELEPLRTEIVLGLTIGIMTMAKAITGIEDLAGDVDLDFPEPEGFDKYRSKLSSTIRFNQPHLISSFDKKYLGFKLVNADPIASQIAINQCEAELSALGERRRLAMRVRDILSNSEQHYLSIENVAEYLHMSDRTLKRQLAAEGTSFSTLVDEVRYRHATSLLSRTDYSLEQIADELGYSDVANFSRAFKRWSGRSPSNWRKDPYL

SEQ ID NO: 6650 - protein, 409 aa, Acinetobacter baumannii
NKDEVMDILKTQVAIIGSGPAGLLLGQLLYKAGIDHIIVEQRSAEYVASRIRAGILEQVSVDLLKQAGVDQNLKEKGLPHSGIEILTNGEKHRVDLAALTGGKQVTVYGQTEVTKDLMAAREAAQLTSFYEAQNVQVKDFYTAPKVEFEYQGKAFQIHCDFIAGCDGYHGVCRASVPEDKIKTFEKVYPFGWLGVLADVPPVADELIYVQSERGFALCSMRSETRSRYYLQVPLTDHLEDWSDEKFWDELKNRLDPESREKLLTGPSIEKSIAPLRSFVTEPMRFGKLFLAGDAAHIVPPTGAKGLNLAASDIAYLSSALIEYYAEGSEQGINEYSDKCLQRVWKAERFSWWMTHLLHRFETESEFDHKIKQAELSYVLGSIAGKTTLAENYVGLPYEIKQIDSFKHAS

SEQ ID NO: 6651 - protein, 238 aa, Acinetobacter baumannii
HRSDVFDDVWQRMSSGQQVLLKLRKMIISGELEGGARIAEIPTAELLGVSRQPVRIAFRLLEQEGLLIKNPTRGYTVREISGKLVHDALEVRGVLEGLAAKTLAEQGLSEEQKKTLQHCIQETEQLFNETDEFGDAELERYHHFNVIFHDTIIEGAQNVALIQALAKNNQLPMASAQAITYDQNQALSEYRRLHYAHLQHCSIFDALVNRQAGRAETLMREHSSVVILGETLRNVLSA

SEQ ID NO: 6652 - protein, 287 aa, Acinetobacter baumannii
KMSDSNYIPPQVWQWTGEKTDLNQPTSGARYEHTLPVGKHPLQLYSLATPNGQKVTILLEELLALGHKDAEYDAWLIKIGEGQQFGSGFVDINPNSKIPALVDHSQNPPLRVFESGSILLYLAEKFKAFIPTDIAARTECLNWLFWQMGSAPYLGGGFGHFYAYAPVKIEYAINRFAMETKRLLDVLDQHLAKNEYLAGSEYSIADIAAFPWYGGLVKNWVYNGAEFLGVDQYKNVQRWADAILARPAVQRGRMVNRTFGDLTTQLHERHDASDFETKTQDKLQNQS

SEQ ID NO: 6653 - protein, 96 aa, Acinetobacter baumannii
DMDDWQCKYCNGYIMVNHSRIEVGEKVYFLVYKFDAKNERKKLYKKGTVIARCDSILHIESRKKTYKIEEAKVYPLGAPMPFVYNMFWICGCENRP

SEQ ID NO: 6654 - protein, 207 aa, Acinetobacter baumannii
NGGDMPKKKEFEHGGARENAGRKAQFNEPTKVIRVPESQVNFIKNWLLNNVKTDNQTDFTSKLKIQQVHPNNDKIYHIPLATERVAAGFPSPAQDDIEQALDLNEYLIRNENATFIVKANSLSMLDAGIDIDDPLIVDRSIPAKSGDIVIALIDNDFTVKRLMIDTQFQPPKVWLKAENPDYQNIYIEEGQELVIWGVVTYNLKRMR

SEQ ID NO: 6655 - protein, 232 aa, Acinetobacter baumannii
WSLDVNKSLLEQLSPTNCQVIFIDHQPQMAFGVQSIDRQVLKNNTVGLAKAAKTFNIPVTITTVETESFSGHTYPELLDVFPDAPLLERTSMNSWDDQKVRDSLAKNNHKKVIVSGLWTEVCNNTFAFGAMLEGDYEIYMVADASGGTSKEAHDYAMQRMIQAGVVPVTWQQVLLEWQRDWAHRDTYDAVMAIVREHSGAYGMGVDYAYTMVHKAPERTTSKHEVLAPVPAK

SEQ ID NO: 6656 - protein, 295 aa, Acinetobacter baumannii
YGLDYESLSAINPKLVYCSITGFGQNGPRAEEPGYDFIIQGMGGLMSVTGERDDLPGGGPQKVGVAFSDLATGLYSTIAIQAALLNRHVTGLGQYIDMALLDVQIATMANQGMNYLSSGNIPKRYGNAHANIVPYQVFKASDRDFIIACGNDTQFIQLCRSIGLPDLPNDVRFARNADRIKHRDEIIGILQTHFLTKTADEWVDAIYAAKVPVGVINNLEQAFQEPQVIAREMLVEMNHPQREKLKVIGSPIKLSRTPVEYKTAPPLLGEHTQAVLGRIVSSEKLAELKEKGVIG

SEQ ID NO: 6657 - protein, 344 aa, Acinetobacter baumannii
NIVEYRYDALGRRIQKRSKHHHTGGEHNIIYGWDGNTLAYESNEQITKHYIYEKDSFVPLAQAVYAEEIELHQTPDWADKPYSLQRDPLWKVTKTAKDFKDFWFYHCDHLGTPQEMTDHTGVVIWKAQYKAWGECKVEQAKSDFFENSEIISNNIRFQGQYFDGETGLHYNRYCYYSPYVGRFISKDPIGLLGGSNIYAYAPNPVGWVDQLGLAKTPTRTLQKNWKNYVGCKHTNLDIHHGFPEEYAERFKNIAGIDVNNPQYYYNLPKEKHTKSPGIHTNSSRTGQNWNKTWGGILNQVEAMNLSQAESKEILEQRLRALARKERIGKHNATAVKGANFCQLQ

SEQ ID NO: 6658 - protein, 207 aa, Acinetobacter baumannii
QGSDMKLYYSPGACSLAAHIILNEINVDFDLERVNLKTHKTEKGTDYYEINPKGYVPALEINPGLILTENVAILPFLAQHDPKQDLIPPSGLGRAKVLEWLGYLNSELHDAYAVFFGAPLTNDEKTKAYAEIDRLLKYIDNYLAESDYDYLVNDNFGPADAYLFVLTNWSNSIEHDLTPYKHIIALRNKVAERQSVQIAMRDEGLIS

SEQ ID NO: 6659 - protein, 221 aa, Acinetobacter baumannii
DFPDCFTDEAVMEVFLVIAFTHFLALLSPGPDFFLILTSLLQKGRRYTYGIVLGITLGNALILAGCLFSFMLLGNLSSILLLIFKWLGALYLAYLSFLCFNAARSTVLNFSTDVNNLSDQAEDKHNKIKSLVLGLQSSLLNPKNIMFYSSLMLLIQHKFSLFQKLLMSVWMVSVVLIWNILWVKLLANDRILIKIKRSATGLYYCSAVAFILFAVLLITYK

SEQ ID NO: 6660 - protein, 395 aa, Acinetobacter baumannii
NNQDRTFMREYAVFTSESVSEGHPDKMADQISDAILDAILKEDPYARVACETLVKTGAVVLAGEITTTANIDVEAVVRQTVNGIGYHHSDLGFDGSTCAVINMIGKQSPEIAQGVDRQKPEDQGAGDQGLMFGYASRETDVLMPAPISYAHRLMERQAELRRSGALPWLRPDAKSQVTFAYENGKPVRLDAVVLSTQHDPEITQTQLKEAVIEEIIKPIIPAEMFHAATKFHINPTGMFVIGGPVGDCGLTGRKIIVDTYGGMARHGGGAFSGKDPSKVDRSAAYAGRYVAKNIVAAGLADKCEIQVSYAIGVAEPTSISINTFGTAKVSDELIIQLVREHFDLRPFGITRMLNLIQPMYKQTAAYGHFGREGSDTAFTWEKTDKVEALKDAAGL

SEQ ID NO: 6661 - protein, 614 aa, Acinetobacter baumannii
FQQELKRSGCVVIEELLPFYEKQLQEFGQQSREFAQKYPKIAQRLSLNQEQIDDPHIERLIQAFSLIAARIDKKLTDSYDVFTRSLFEVMFPQYLRHFPACSVVSFEDINKIKQLTEPHLVPHHTVLKSRSFKGVQCEFNTTQDVKLLHIHLSGLDFKTTPSAHMHLNQNATLSLKFEIFNNAHACLTDEKLPIYLDAISNFPLQVLDSIFKKGTSFAVKYGQTIVELSKNPFELIGFAEQESLLPLDQHTHHAYRLLMEYFCFPEKFSYLKLDLDFLKRIPQHVSELELLIHFKLNLNDQAVVRNYSELNIANFKLFTTPVINLFEKYAEPQKIVHKQLEYPLVTDAHHPEFYQVYSILEMNMVREKTNQEESYVPVLPFFAMSHYHNDTARFFYSVNYQKLQSNFVEMGYSIISKNLNPFSTRSDFISTKLLCSNRDLPHEALGQSNNVLNLNDSSLARRAIVLKRPTKPYKFEQGQSEQWRVISHLSLNSLALMKGDAVSHVKELLALYNLPQSKENYLIIESIKKLEFSLTHKLVDGKPFPMFVRGVKAELQIDSSVFRGHSLYIFSQLLSRVFNLKVQINSFVDLVVKDYSSQQELYQCSQNVGGKTLL

SEQ ID NO: 6662 - protein, 66 aa, Acinetobacter baumannii
SNKEDIMLLNRKHSLVSCFDLELLETHPVKIKSSKVKQKNFITDSLEFSLKKSRQFFNERDFKKIA

SEQ ID NO: 6663 - protein, 493 aa, Acinetobacter baumannii
GSKDGAILVGHGCIGQNMSQKKSVLFQQLLPVIKQYQQSGFTHEKIVELLKDQHDLNLVTVKTFKSYLYRYAKVNPAMSKNTATLQSMPTSREIKKSSKLEHVCYDIRGPVLRAANEMEEQGHKIIKLNIGNPAPFGFEAPQEIINDVALNLPNAIGYVDSKGIFPARKAICQYYQQKGILNMHVNDVYIGNGVSELIVMAMQGLLDDGDEMLIPMPDYPLWTAAVNLSGGTAIHYKCDEENSWYPDIADIESKITSNTRGIVIINPNNPTGSVYPRHVLEQIVALAKKHDLILFADEIYDKIVYDGIEHVAVASLAGDQLCISFNGLSKAYRIAGFRSGWMAITGDKSRAADYIEGLDMLASMRLCANVQAQYAIQTALGGYQSINDLIRPGGRLYEQRNIAWEMLNEIPGVSCVKPEGAMYCFPRLDPNIYPIEDDEKLMLDLLRAEKVLLVQGTGFNWPTPDHFRVVFLPAENELREAIGRLGRFLANRR

SEQ ID NO: 6664 - protein, 162 aa, Acinetobacter baumannii
STGEKRMSLTPQAIPGMRARLHMPEEILSLPVAGNTVLSDGEVVVQSTDGKTVTAVTGATNTKFGVVVLQHVGKSGKNALGKEAYQAKDCAPIMQIGSIWVKPTAPVIDINAKVYVRIANPTAQAPLGSLSSAALDSTELPNASWETITGPDGLAILRLRGA

SEQ ID NO: 6665 - protein, 311 aa, Acinetobacter baumannii
EYLDVNMEIDEELTLKKIQIFLAFMRCGNLSKTAAEMQLSNVSVHKALHSLESALRCPLFKNEGRNLIPLKSAYVFEERAQKIVQDIFITVNKTREAAGFAAKVLHLGSLYSLTVNTIPNVISGLKLRRSELDIQLLLSSNQDLVKKLKATELDAIIVALNETTQDDDFEILPMFSDDIFLAVNKDSKYAEFKDIDLSLLKEETFLTLTKGFATHNDSDIIFKKAGFSPKVALQVNDIFTLISMVSSGVGFALLPGRISAVYESSVKLIPLKQQYHMQQEIGLVFLKSKERDPNLLALIAECRMFASNFKR

SEQ ID NO: 6666 - protein, 66 aa, Acinetobacter baumannii
EISFINSDELNYMDKKDGDLSFESFKNTNKPNFFGDIEYIYSIFKIKELPVDLLFKILNLVFLISL

SEQ ID NO: 6667 - protein, 242 aa, Acinetobacter baumannii
VCMEQDQARIPKYIPIRDAIAHDIESGVLEAHAKLPSERVLSEQFQTTRVAAREALLALETDGLIYRLDRRGWYVRSPRIIYHPQSTKNFNQFVIEQGYEPSTEVISSELTQATFWDAKHLKVEKGHPIYSVWRRRCINGRPVLVEHLRVNAELFPEFLTHDLKQSITLLMANQYNCHITRADINLYPTALSEQQAKALHVNVGALGLYICRSNRNEEGVITDVDQEYWLHDVLDLHFEARV

SEQ ID NO: 6668 - protein, 298 aa, Acinetobacter baumannii
LSMDRLDCISTFVSVVEHGNFSSAARALDISRDLVAKRVCYLENDLKTTLLNRTTRQMNLTSCGEKFYQHCKVILSEFEWATYEISYNQQYPEGELKLNTPMSFSNIFLQHIISDFIEKYPSIKIDLFMTDQLLDVNQHKFDLTIRLDGSAPSLANSKILNTYQRYLYATPEYFNQHGLPTSLEELKEHKFLIYYQDSRHKKLIFQKDQKEVSFNCFPVMTCNNGELLLDMCLKDHGIVFLPEFIAEPYYKEGKLQKCLEDYTSQPLHLYVTWPNRKILSKKVKLFIDFLTHQIIPIK

SEQ ID NO: 6669 - protein, 445 aa, Acinetobacter baumannii
KDMENKASSLKKLSLWQVTIIGIAYMTPMTVFDTFGIVSGITNGHVPLAYLLALGAMLLTAWSYARFSQNSEKSGSAYSYTAESLGPKSGFFVGWCSLLDYLLLPLINVLLAAIYLTALIPSLPYWFWVLVSAGLVTLVNCFRIRLLANLSLVFVFAPIILMVIFVYLVVQGIGSTQGYEHVLTLAPLWHGQQSLLPLVAGASVLCFSFLGFDAVTTLSNETKQPTKNIPRAVMLTTLAGGAIFFTAAWFIQLYFPNNVRFHHPSEALPEIVLYVGGALFQSIFLCGQIMNTVASGLASHASASRLLYIMGTDNIFPKKYFGTIHSSLGTPFFSVLFVGLISMSAIFLDLAQVVSLISFGALVAFTAVNFSVFMKFYIKDKQRSGFKNKFLNLFLPLLSVISIICLWLNLDSSSLTFGCFWLALGILLFIYKTIKKQSIAISNAY

SEQ ID NO: 6670 - protein, 419 aa, Acinetobacter baumannii
AQMDEERINMSLLKSSFLSDRQWAIVASIFMMATSAMGPGFLTQTAVFTVKLGAAFGFAILISILIDYVVQQNIWRVVTLTQMRASDIANKALPGSGYLLAFLVILGGFFFSVGNIAGAALGLNALFGLDTKWGGILSGALAILIFASKKATLAMDKSMIVLGLLKILLIIIVAVIVMPPVGQAVQQTFAPDQIDFAIITTIVGGTVGGYICYAGAHRLLDKGAVGPENINEVAKAATKGIVVVGIMRYVLFLAFLGVVVSGAHIDLASHDANPAAQAFQYAAGTFGFKLFGLIFWAAGISSTIGAAYTSVSFFTAFKKNLTPKQTNYTTITFIALALLLYVLLGATPAGLLIFVGGFNGLVLPIGLTIFVYVAACRKDLMGNYNYPKWLLILGGLTCLLTWWMGYMSFTTVFNYLTKL

SEQ ID NO: 6671 - protein, 407 aa, Acinetobacter baumannii
LKMEKIVEPNAENILSKSFIFIMAMTCGICAGSNYYNQPLIYSIADALKVNADQVALTIVISQLSYAVGLFILVPLGDFFEKRSYICLLMCCTGLAQVGLSLSQTLPALYGFTFLATFFSIATQVLVPFAAGLASPKKSPQVVGTLMSGLFLGILLARSIAGLLSTVWSWHAVYLISGIVILVFAWVMWVKLPVARKSHQLNILQIYGSLFSLAAHQPHLLRRGFAGGIGFGILALIFTTMTFILANEPYHFNDFQIGLFGIVGLAGVFATPWAGKKIAAGLENKIAVICMGLLMSAWIPLFFAQQSLVAYAVGVIMAYFGLSAFHVLNQNLVYRISAEARSRINSIYMTLYFGGAALGSFIAVYAWKHWGWEACAALGLAMAMLSFLIDRLDFYEMNKIAKQEKAP

SEQ ID NO: 6672 - protein, 261 aa, Acinetobacter baumannii
TESEVKFMVELLLKDLTHLGLITAFALIALIMWLSTKLSKYLTNGRVHASAIAIVIGLILAWFGGKMTGGEKGLTDLALFTGVGLMGGAMLRDFTIVATAFEVQATEAKKAGFIGAFSLFLGTILPFIVGCMFAWIFGYRDAVSITTIGAGAVTYIVGPVTGAAIGASSEVMALSIATGLVKAICVMVSTPLTAKFMGLDNPRSAMIFGGLAGTVSGVSAGLAATDRRLVPYGALTATFHTGLGCLMGPTILFFAVKALVG

SEQ ID NO: 6673 - protein, 470 aa, Acinetobacter baumannii
QNSLLKNNAMLHKLEVKKMDTSKVNINELIDKASFTSFHWKVLIWCLLIIIFDGYDLVIYGVALPLLMQQWSLTAVEAGLLASAALFGMMFGAMIFGTLSDKLGRKKTILICVTLFSGFTFIGAFAKGPTEFAILRFIAGLGIGGVMPNVVALMTEYAPKKIRSTLVAIMFSGYAIGGMTSALLGAWLVKDMGWQIMFLIAGIPLLLLPLIWKFLPESLAFLVKSNHSEQAKGIVSKIAPETQLNANTQLVLNESTTTDAPVRALFQQGRTFSTFMFWIAFFMCLLMVYALGSWLPKLMLQAGYSLGASMLFLFALNIGGMVGAIGGGALADRFHLKPVITIMFIVGSAALILLGINSPQFILYSLIAIAGAATIGSQILLYTFVAQFYPTALRSTGMGWASGIGRIGAIIGPVLTGTLLSFELPHQMNFLAIAIPGVIAALAIFMVNLKASVAAQTPSTFNPQNTLTQQ

SEQ ID NO: 6674 - protein, 75 aa, Acinetobacter baumannii
KHQDQGKKQTIHNNFVDYLVISLIIVFSLQQAFSFSVCEISITIRHPNYNRVLSLLFCVIKKQGKYNKFKKFIDI

SEQ ID NO: 6675 - protein, 416 aa, Acinetobacter baumannii
SIKDNTMEKISGQPSRAKITLLLCFAIAIFEGFDLQSMGVAAPRMRAEFMLDNAQMAWAFSAAILGTLPGAILGGRFADIVGRKKILIFSILLFGIMSLLTAYAANFSLLLLIRFCTGLGMGGALPMMITLASEAVPDQHKGTAVSVMYSGIPFGGLLTSVVAMSLAGDAEWRHIFYIGGIAPILLIPLIMRFLPESNDYLQRKVQAQKTTPFFEVLFAKERRMSTIQLWISFFCTLVVLYFLLNWLPLLMGAQGLSKLQANYVQMGYNVGGILGSILMGVLLDKLRMSFVIKLIYLGILFSLCCLAISPTVALLALSAVGCGLFIVGGQSALYGLAAMYYPTEMRGTGVGAAVAIGRIGSFAGPLMAGFLLSLGQSSTIVIGSSIPVILIAAISALLLVKKPKQPVHLVQSSGAR

SEQ ID NO: 6676 - protein, 321 aa, Acinetobacter baumannii
GHEEDMKGIKTIGVVGVGVIGASWTALFLYKGFKVKVYDPYPIDEELFKKRIQTNLSDLLALDQQTDSSHHLQDIFLNLELYNNLKDAVINVDFIQENAPERLDLKQNLYQEITSYCPEKTLIASSSSGLKVSDFQKDATHPERIFLGHPFNPPHLLPLVEIVGGKLTDPQILKKASEFYQSLGKHPIVLNKEVKGHVANRLQAALWREAFSLVKEGVCSAEDVDIAITSGPGLRWALFGPYINMELANQKGFKEAIHHLGPPMTEWWNDMQNFQHSEETTELLEEQTKELLTHYKDVDLSQKRDKGLVDILKLRQQLELD

SEQ ID NO: 6677 - protein, 816 aa, Acinetobacter baumannii
TFLLMKTFQLKTLSVFLSALGAFSYSSVAQAQLMFSQYVDGSSNKKGLEIYNPDGTTVNLADYEIQQFNNGGTAKTATFRLQGTLASKQKFLVGRSELQTELGNKVNQVAALSFNGDDAVVLVYKGTPVDRFGRIGERPEAGWGTAVSSLGNSFKRIETENPALSIDPTAAFDLDHSWTAWANRNDFTNLSGTTTQPPIETVSCSSSDTPIADLVTSAQNQTYTVRGVITADYRYANGFSGFYVQTPDTKARANVSNAIFVYIPNSSAVKGGQIGDEVILRGRLTSYQNQLQIDQLQQDIQTCNSNMANQVQPISLELPFSSLTAGSTHSPQRYQGMLVKLPQTLTVSENYNYGRYGELSLSLGRLYIPTNLYPALSPEAKALAQKNLLSKIIFDDGYNNQNRTPWLPTNFSVANTLRSGYQLKNVEGILEYRFNGWRVQPVLGRTQPEVITQTNPRQNIITKNANHIRVASFNVLNYDNGATGFPTERGANTQAEFDKQHHKIVSALKSIDADVYGLMEIANNGYGPNSAIAHLTSALGPDWKYVIPENLDRLGNDVIAVAIIYNSKRVKPLNKAVVLDLGDKNRTTLAQTFQAVRGNKIFTVIPNHLKSKGCSGVDASSSDADQNDGQGCWNPTRVKAVDQIVQWLAKNPTQVPKQNALLVGDMNSYAKEAPILAFEKANYKVLLNDAKVGQGAQAYSYVFGVASDANGNGGVGNLDHAIADADLYPKVVRTFAWHINADEPTVLDYNEEYKTDEQKALFYGEDAYRSSDHDPVIVDLDLNGKDSNQPNDNQKSPIFDFLSQLMEWISQLFKRS

SEQ ID NO: 6678 - protein, 350 aa, Acinetobacter baumannii
RGSLIMRFSLFVHMERVSDQQTQKQLYDEMIELCQIADRGGMHAVWTGEHHAMNFTIAPNPFLNLVDLANKTKNVRLGTGTVVAPFWHPIKLAGEAAMTDIITNGRLDIGIARGAYSFEYERMVPGMDAWSAGQRLREMIPAIKNLWKGDYEHNGEFWQFPKTTSAPQPLQQPHPPIWVAARDPNSHEFAVQNGCNVQVTPLHLGDEEVEKLMGHFNAACEKFNEIQRPEIMLLRHTYVADSEEDAQLAADEINTSYNYFGAWFKNEREINQGLIAPLSVEEIAAHPFYTPEAMRKNNVIGQAQEVIDRLKAYEAMGYNEYSFWIDTGMSFERKKASLERMINEVMPAFA

SEQ ID NO: 6679 - protein, 705 aa, Acinetobacter baumannii
KRSLVMLEQAHLEGTSTDTDFQQSEHQLPHLASYVYGTWHSSDEELRTVYHAITGESIYAVSSHGIDMKRVVQYAKQNGSELANWTFHQRANALKQIAQHLLERKEDFYKLAYATGATRKDAWIDIEGGIQTLFAYSSLVRRELNDEKIITEDSWIQLSKNGTFGAKHILSPKAGVAVHINAFNFPIWGMLEKIAPTLLAGVPCIVKPATDGAQLTQAVVKAIEEAHVLPKGSLQLICGQTYDLLEQLGPQDCVTFTGSAYTGQKLRNHPHLNKYSIPFSMEADSVNSAILSPEANEETVDLFVREVFREMTTKAGQKCTAIRRAFVPENLLATVEEKLTAKLAKVVVGDPQKEETTMGALASIKQKHDVAEKVAELSKDAKIVFGGNDSFTFNADHPEKGAFFAPTLLVCEQPLQATNVHTTEAFGPVCTLMPYQNIEELADLVSRGEGSLVASVVKNNDENIEQIIQKIAPWHGRVHVLDAESAKESTGHGSPLPHLVHGGPGRAGGGEELGGIRAVKHYMQRTAIQGSPNSLTQITHSWTAGSKVNEDRVHPFKKSFDELVIGERLLTARRTVTEADIVNFACLSGDYFYAHTDKIAAAESFFGERVAHGYFIVSAAAGLFVDAAQGPVIANYGMDNLRFVEPVKIGDSIQVELTCKQKTPKPQKDPSQPAHGVVVWDIKVKNQRGELVATYDILTLVAREA

SEQ ID NO: 6680 - protein, 121 aa, Acinetobacter baumannii
AIILNKALINMKKLSTILTAGVLAMLSVSAFACPKGTQLQGGTGPNHKGGKCVAVHGKATAQKAKKEATKTKQEVKKDLTMQKHDAMTSATHAQHESHQMTHQMKQDAVKTVNTAKAATKP

SEQ ID NO: 6681 - protein, 113 aa, Acinetobacter baumannii
RTILLRKVGRKTAELSSPFYRDKEKNMASPYITIGCPTTGGGQVISGNSAFLIEGIAIACVGDKATCPAHKTVSTIVSGDPNMQVMGKAAARVNDSLSCGCKLLPKQSLVNQG

SEQ ID NO: 6682 - protein, 1020 aa, Acinetobacter baumannii
LGGLCRTSSFTLPGVADQEELTRLVLRKIVSKELSDKERERISGTGWLASFTVNENGCLSADSYAPASYVYGTQALSHGEPLIDLNARLTRAKEEFAQRCHRLVQLKEDYRCSWKDLQSETDLIRSIFAHDEQIGLDWRVVVATKRLPRKKALEDIEQEVNYLNSFYLDDLDKMLKQSSLSQPFGQALSTYLGASIIHDKRIDILKNHEIMGKLVCAANLPIARWPNAPDRPLVLAQQAVVAHIENSLKNQDGILGVNGPPGTGKTTLLCDVIATVITDRAKRISALSTPEAIFKQPIQLMGRRFSPIVEELVRDSSIVVSSNNNNAVKNISQELPATSKLDKRYETDSLYFSEVISGVFDSQRVQDENQKTIPAWGLIAAALGNSTNRRSFARAFFKEDHIAENDEEESKNSFISMKQILEDAIPHISAYCRKWHTVKSELIELIEELEKKRSVLIKAEQASLVISECMERKKELSETITLKNEELNKHQDLYRQIQGELQDQAILIQSKQQILGQIQISHGPRLWDRLCALFGYRTHRTEVYDKRISEATLSLQETTARYEKLINDKTSSHKIIKICEQELLKLNDELLVIRQKCDKLISDLQAVHALGVRHVIGPDFWKLSFEELHRTSVNTSEIIDDIRARIFIKSIQLHRLTILSNAKRFLSNLRMVGQMLSGNTKGLSLHDRPVIWDSLFFVVPVVSTTLASFSRLFAGMGQDSLGWLLIDEAGQATPQSAAGAIWRSKRAILIGDPLQVEPVFTLPDSVVEILRKQNDVDLSWSPVFESVQTIADRITPFGSWIDDGSGDNQSRIWTGMPLRTHRRCDDPMFSIANSIAYGGQMVQGRVDREGKPTPANIAYDIGVSTWMHVDSIDFAHPVNSEELDVLIDSLRKLEEKRKTTINSSKIKIYVISPFRKVIQACKSSIEEAGIKGIECGTVHTFQGKEADIVFLVLGTAKDRTGEGARAWASSSPNLLNVAVTRAKSRLYVIGNVDTWSKMDYFSTLVNILPVKTVNISKTYT

SEQ ID NO: 6683 - protein, 525 aa, Acinetobacter baumannii
IKFCIGRKIMVTKPRTNTRTRKTQEVAHIYDTFIVGAGISGLAAAIKLNEAGLTNFKIIEKASRVGGTWRENTYPGCGCDVPSALYSYSFAPSAKWSHLFARQPEILSYLEDVSREFDIESLIEFNTELLKAEWDNVKNVWKLETSSGLYIAKTVLFATGPITEAQIPRLEGLDTFTGEMFHSAKWNHDYDLTGKRIAVIGTGASAIQFVPQIQPKAKELFVFQRTAPWVLPKPDTDLGELSKSIIAKYPAIQASWRQTVAGTLNVINFGLRNPKALKPVNFAAKQLLKLQIKDPVLRKNVTPNFDIGCKRILFANNYYPALQAPNTTLIPHGLVKVEGNTVVAANGERHEVDVIIWGTGFEVSHPPIGKRVHNEKGECLAELWKDSSPEAYLGTNIENVPNAFLMLGPNVLVYDSFIGLAEAQLQYIVDGLLQMKAKGIAKLSVKSEIIKKHNELVQKHLQTTVFNSGGCKSYYLDANGRNFAAWPWSLKKLKQRLHHLNLEEYNIIYEADLVKVKPKVEEVAG

SEQ ID NO: 6684 - protein, 212 aa, Acinetobacter baumannii
SQLCIKVIKLYWISVNMQQTNKRYPLGAHLIVKHLGYSHHGIYAGRGRVIHYSGLAHFIKKRPIEITSLDAFSHGKKIHVRSYDAPRYRGKVVVRRMRSRMHENHYHLIINNCEHLCSWAITGIESSTQVERMMHRLTTIGYVSSIMSYMNGMMLTVATTCFALVLYIKKKLRDQAKMNIPTYQFLREKAEKRNIDPTSPLVFIEPDKKETI

SEQ ID NO: 6685 - protein, 301 aa, Acinetobacter baumannii
RASCCNCELLRKPSKSSCNSIIFIKLRGYIMTTNNTQIQAVVFDWAGTTVDFGSRAPILAFIALFKDNKVEITVEEARAPMGLEKRDHIAAVLKMPRVAAAWQEVYGQAATEADIDRLYKDFIPYQLNSIPKCSALIPGALETFENIKKRGAKIGSNTGYASMMIGRLVKDAADQGYRPDCIVTASDVKYGRPYPEMLWKNLIQLDVSDIKTVVKVDDTVVGIDEGLNAGCWTVGLAISGNEVGLSYEEWSALSADEQIVLKDKAYQKMNASGAHYVIDSVADLPNVLDDIERRLEQGERP

SEQ ID NO: 6686 - protein, 202 aa, Acinetobacter baumannii
IMPCYSIDGVIPVVSPEAFVHPTAVLIGDVIIEAGVYVGPFASLRADFGRIHIKQNANIQDSCTVHGFPQSVTLVEEMGHIGHGAILHGCRIGKNVLVGMNSVILDYAEIGENTIIGANSLVKTKDIIPANVLAMGSPAKVARDLSEQEKKWKTRGTQEYIELAQRCLNSMQEVQPLASELDDRLTYKDFSSSNYQIKQDSV

SEQ ID NO: 6687 - protein, 502 aa, Acinetobacter baumannii
FMYCSTINAEDLNRIMIMQLNELALFRQQAFIAGKWCDADHQQTSKILNPATLEIIGTVPNMGKAEAERAIEAAKEAWPLWKNKTAKDRSIILKKWFDLIISNADELAFILTSEQGKPLAEAKGEILYAASFIEWFAEEAKRVYGDIIPSPYPDARIVVNKQPIGVVAAITPWNFPAAMITRKVAPALAAGCPCIVKPAPETPFTALALVDLAVQAGVPAEIFSVITGDAVHIGDAIFESDVVRKFTFTGSTPVGKMLLERSAKTLKKVSLELGGNAPFIVFDDADLDAAIEGALIAKFRNAGQTCVCVNRFLVQAGIYEKFIAALSQKIQNFNIGNGLEAGHDIGPLINANAVKKVEAHIQDALDKNGRLVVGGKKHKAGELFFEPTLIADVTADMDVATQETFGPLAAVFKFETEQQAVEMANATEFGLAAYCYTKDLGRAWRMSEQLEYGMVGINKGLISNEVAPFGGIKQSGLGREGSKYGIEDYLEIKYTLFGGLNI

SEQ ID NO: 6688 - protein, 222 aa, Acinetobacter baumannii
AMELDYLFQASHLERLMWGLWATAKIAFISVFFSAIFGTVFGVIMTSKNIVVKSLCRLYLEAIRIIPILVLLFVFYFGFATWFNWQFSAMWVCVVVFVLWGTAEMGDLVRAAITSIDQHQRDSAYALGLTHVQALIYVIFPQSLKRVTPGAINLFTRMVKTSSLAVLIGVVEVIKVGQQIIENSLLTVPSASLWIYGFIFILYFLICYPLSRLAAHLEKVWE

SEQ ID NO: 6689 - protein, 131 aa, Acinetobacter baumannii
CFSCNSIKDHLEFGSMNNMKYTYKPNYFFFAHKLVLFLKDYLLKHPTEQNTTFNLQTIYDVFSHDLASSTTNLEGILNIADEYVLETEEGLLPLISSHSINLKNHVLSLEFSPKALTSLLSGRSLVNPKAA

SEQ ID NO: 6690 - protein, 189 aa, Acinetobacter baumannii
LCTCFRNVGVDKTGFLDPKSKLFNPNHLHLCSFRYSDIAVIWAKFGFKKQGRQIIGTTEKLMINAGSWKKERQEEQFIEWFEYISEYLITFDASYSQIASVVNFCVLVEHELYHIAYKKDEWGTSAYNQETGVPKLAIQKHDVEEFTGVVRRYGASEDVKRMVEAANTRPEMSRADVHYACGTYYLKVV

SEQ ID NO: 6691 - protein, 376 aa, Acinetobacter baumannii
TTACIFLSSCIFRFMTSSNTSRIAVQQIDPHELKTWIKAQALDLGFADCVIAKPDAQEQMPRFLEYLERGYHADMTYLEENLEKRADPTLLVPGTKSIICVRMNYLVESPKPRYVPFEPNSAIIARYARGRDYHKVMRGRLKTLATRIREKVGDFESRPFADSAPIFEKSLAESAGMGWTGKHTLLIHKKSGSFFVLGELFTSLDLPFDEPATSHCGSCSACIDICPTQAIVEPYMLDARRCIAYLTIEYKGIIAEELRAGIGNRIFGCDDCQLICPWNSFAKTASIPDFNPRHGLDNISLLDIWQWDEATFLANTEGSPIRRTGYQSFKRNIAIGLGNAPYSKEIVDQLNNGKSLHDEIVNVHIDWAIEQQLNQL

SEQ ID NO: 6692 - protein, 316 aa, Acinetobacter baumannii
KSCCIKISEFESLHMSTPTEAKFSLTYYTGFLSVLFAAFLWGTAGTAASFAKGISPLVIATISVGFGGLIHTFLSLKAIKKDYRKLFDYKTKVLIAVIVSILCPFAFYSSVSLAGVSIGTVISIGCAPLFSVMLEWLLDKRKLSLKWLISFILGFLGVVLFSYAGEHSHQHQGVQSERLSGVFLGLLSSLSYATYSWIMKNLIHKGIDSRAAMGVIFGISAVLLLPTLLITATHLFNYPNNIWVALYIPIVPMFLGYLFFSFGLKRIPASQAMTLALVEIPVAALLAVVVVGESLTMNSYLGLILIFLCVIVLTKK

SEQ ID NO: 6693 - protein, 74 aa, Acinetobacter baumannii
AFRLINLLGHMKRYWKQTDSIASRWTTEQDCFLIENNSLSIDELKEHLPFSEDEIRVRRSVLGLVRRDQQMRPY

SEQ ID NO: 6694 - protein, 207 aa, Acinetobacter baumannii
FLLCFISFMAFTIASPVTFEEEIKKSRFQAIAAPVENEQQVKEFLELNKDISTTHQCWAWKIGHNVRFNDDGEPSGTAGRPILATIEGNDLTNIIVMVNRWYGGIKLGTGGLVRAYGGCAGQSLLLAERIELIAKKTIHFSCHFNEWAIFQYELTQQQIEYQESYTATGVDIEARLQVHQIEPLALKLRDVTRGREELKVEEELTDD

SEQ ID NO: 6695 - protein, 214 aa, Acinetobacter baumannii
IVMWQLYGHEFLTLALIHFMAVILPGPDFVITVRQSVRYGYLIGCLTAIGIGVGISVHVFYTLVGIGFLIQQSEWLMSLIRTAGAAYLVYLGWQCLRSQPNTNIEINGQLDSDTPSLFKAFTMGFLTNALNPKATIFFLAIFTTIVSTTTPMKVQVFYGVWMCMVNAIWFMVVSVLFAQPIVRKRFLEFGVYFERVMGVLLIGIALRLIWGLFN

SEQ ID NO: 6696 - protein, 138 aa, Acinetobacter baumannii
YLRCEMNIGQASKHSGISAKMIRYYEEIGLLEAAQRSASGYRIYSETDLKTLNFLKHARELGFSSEQMKELISLWKNTDRHSAEVKALTVKHIAELKQKIAHLQEMVNILQASADDCCGDQQASCAILDHIEKGVGVS

SEQ ID NO: 6697 - protein, 341 aa, Acinetobacter baumannii
HNLLRELSHDMETNLYIQGGALMHTLKTTPLYYGKSPARGDFLKTKGQYALIQVLDQWITEALEYAMQSNMFKEAYSNLPSLDFFIANPQENMFLAANLLASEDSSGRAFPMVLSHLLEIDLPYENLLYAPYSYKHVLIDLFQNNRALRGIKDSDLLFGKLNHLPNQIQVLSERECVGFYENHTMHSFAQLMKLSIYELAQSMIGLGLLLQPILQNGTSRLNKVLILPINNPAYCYEIAAFWVSIICRFLKQHNTEVLIGLLHREQPVLFFGFQGADILALSDIFTQNMDSKHWVSLIQAQWIDTYLEQNAGLATLEQSLCQRQLSLNQGLKLFRQTFLGE

SEQ ID NO: 6698 - protein, 60 aa, Acinetobacter baumannii
TILLFKHSIILKYHDLTIHAYDSQVQPLSAEKLVNYNFCVKYFYYLDSSIGPFKIMHMCA

SEQ ID NO: 6699 - protein, 264 aa, Acinetobacter baumannii
RISRTENDAFKAIISLWWMTKIIILLFVSYFEVKRIFVTLPSFNVSNLGAMPSVSEVIVKYIREAIIAGHIAEGEPIRQDEIAKLFNVSKIPVREALKQLEAEGLVEFIKNRGAIVTRISEEELAQIFEVRVMLETKLIQLAVPNMTEETYKKADEICNAFIDNMDIGSWTTLNWQLHACLYEPAQRPYMLGLIRSIYDKIERYLRLQMNVSEGKSRANDEHKEIVKACKAKDVDLAVKLIEEHINGVCQSLYEHLPHHKNGKN

SEQ ID NO: 6700 - protein, 617 aa, Acinetobacter baumannii
SFMLKWFEKLVDPYPTKGLDEPLPTRFFPFVWQATEGVRPYLLLLIICTAGAASFEALLFSKIGQLVDWLSNSQPESFLSQHASNILILISVLFANILFVNIQSIIKHQILYSTFPMRLRWRFHNLLLKQSLDFFHNDFAGRLSAKVMQTALAVREFWIILGDMLAYVSIYFITVSIVLGAISPTLLIPLMVWLGLFLLSAWFFIPRLSKVSQQQADARAVMTGRVTDAYTNIQTVKLFAHAGRESQYAKASMKEFMTTVYAQMRLGTLFEVSINLLSAVLFVGVIGTAVWLWTQGLAALGVIAATTAMILKLNSMAEFMMWHMSALFENVGTIQDGMQTLGKKINIQDKPDAKPLAVTQGEIVFKDVTFAYNNKNVIDHFNLHIKAGEKIGIVGRSGAGKSTLIQLLLHFYHLKEGAILIDGQNIEDVTQDSLRANIALVTQDTSLLHRSVAENIKYGRPDATDQDMQSAVHKAKAAEFIPQLVDLKGRSGYEAQVGERGVKLSGGQRQRIAIARVFLKDAPILILDEATSALDSEVEAAIQSSLNDLMVDKTVIAIAHRLSTIAQMDRLIVLDEGKIAEQGTHEELIAKNGIYAQLWKRQTGGFLIEQKVIQGQD

SEQ ID NO: 6701 - protein, 141 aa, Acinetobacter baumannii
VNIRLAQWEDTETICYLLKQMGYSQPLKVVQEQFQILSKDPNAITLVAADDLKVYGVLSLYFIPQIALQGDFAKICYLCVDEKMRSKGVGHLLVQEAERLAKQRGCDRMELHSGIQRPLAHQFYLREGYVEAPKYFRKALN

SEQ ID NO: 6702 - protein, 286 aa, Acinetobacter baumannii
RNNRLNLEIDMAQTASKKWLGIGLVVVVLFVALFLWNKHRQSGSNELVIGISPPFAKPLQAAADEAKKQGLNVKLVEFSDWNTPNITLNHGDIDANFFQHQPFLDNAIKETGFKLKAFAVGAASHVGLYSKKYKSLDELPQNARVVIPNDPVNQGRALLLLQQAKLITLKDSNNHLSALKDVVSNPKNLQFIEVEGPQTARAIDDVDLAFGYPHYLRLAKTADPNSALLLDDNTNKRYAILFVVRDDYEDKGDKLKKFVEIYQNSPKVKAVLDAEIGPKLWFPGWK

SEQ ID NO: 6703 - protein, 238 aa, Acinetobacter baumannii
ESLRLKNHINNKTRDRRAHHLCGFCMPVFSTHFKSDGISISVHTTRIYNGKTMPNLETSSKKLHIIRTAIRLFTTYGFHTTGVDLIVKESEIPKATLYNYFHSKERLIEMCIAFQKSLLKEEVLAIIYSSRYCTPTDKLKEIVVLHVNSNSLYHLLLKAFFEIKVTYQQAYRMAIEYRKWLTREIFELIFSLEIRALKPDANMVLNLIDGLMFEFLSTKSLDESDVVVEYFFKPTCLR

SEQ ID NO: 6704 - protein, 340 aa, Acinetobacter baumannii
VMQRIAINGFGRIGRNVLRAWFESPKQFHFEIVAINDIADVHTLVHLFKYDSTHGRFNGKVDITIENEKIYLNIQSNQRLLKVEVLQQKQPELLPWASLKIDVVLECTGLFRSHADATRHLEAGAKRVIIGAAPFDHVDAAIVYGVNHADVKATDQIISSVSCTTQALVPLVKIIDDAFGIETALMTEIHAVTADQSVLDHAHRDLRRARASGQNIIPTTSSALGALKRVMPKMEDRIDGYSIRVPTINVAAIDLTFIAQSPITVHHINELLIKASQTDYAEIMAVTDEPLVSSDFNHSPYSLIVDSTQTMVVGHQAKVFAWYDNEWGYANRLLDLCDSF

SEQ ID NO: 6705 - protein, 286 aa, Acinetobacter baumannii
MFKRNSIKILSSLAVAGVLLTACSKTPSTEQASNAQEDHSLEQVKKNGVLRVAVFADDPPFGYVDSAGNNQGFDVALAKRVTKDLLGDEKKVEFIVTEASNRVEFLKSNRADVVFATFTVTPERKEVVDFAEPYLKGAFGIVSPKAKPITDIAQLEGKTLIVNKGTSSDTYFTKHYPKVNLLKFERNSDAFKALTDGRGDAISQDSTYALAWAAKNPSYVAGIQSIGDQEFIAPAVKKGNTQLLNWLNTEIKQLRTSGEIKKIYDETLKPIYGDSVNPNVFLDVGQ

SEQ ID NO: 6706 - protein, 117 aa, Acinetobacter baumannii
ERKRTKLKDKKFINVDLDNIDEVMESLSPRAAFQVDNTLTEEGGKMAVDLTFKSMEDFRPENVVQQVDPLKKLVEARERLTDLRNKISNSERLEDLLDEVLKNTDQIRKLSAEADHE

SEQ ID NO: 6707 - protein, 76 aa, Acinetobacter baumannii
MIQLFINGQPVSVIEGTSVAAALAQAKSYSRLSVCGEKRTPFCGMGVCQECRVNINGLRVLACQTLCQQDMKVETQ

SEQ ID NO: 6708 - protein, 73 aa, Acinetobacter baumannii
RVQLIYCWKYAHLFEEYPKFLNRYDQGLIMGHSSEFSSKKWAKYSELFGVSSVMINYLNLSTQDEFTRAGWRK

SEQ ID NO: 6709 - protein, 92 aa, Acinetobacter baumannii
IIKLYITYKKKNKHISGNIFQLQSNFKFLLQNHMLIIWKIFCILLLSLGAFGVGLGISYLDFFLFFIGLLFLLCFFLALKQAREDAGSFPDE

SEQ ID NO: 6710 - protein, 287 aa, Acinetobacter baumannii
KSISELMGSMNAIPQTFEFWQDRRMPYVETRRSCFGRTCYKSHSHPTFSIGAIDEGNSVFQSSFGTAQKITAGTLVIVPAHVEHSCNPMPNQAWSYQMLHLDLAWLNQLYSEFQEQGLDLHIPQHKPLIIKDEFLYEAFTEMNETLFDAQKLIFEKEQSLLHCLIHLLLPHFILEEIQKPQYLYKDFLNLIDVISSSEGFISLEELAQRVGLSRYAIIRLFKANVGLTPHAFQINLKINQAREQLKKGVPLAELAVNLGFSDQSHFHKAFKAHTGVTPRQFQLAAAQ

SEQ ID NO: 6711 - protein, 68 aa, Acinetobacter baumannii
GIIRLMRNQIHPINNVDPLDTDNEQKQENSVLNSVNPDPVEVTDLFVEIGKDIADFASSILDNIDINF

SEQ ID NO: 6712 - protein, 453 aa, Acinetobacter baumannii
LGKLQPNKKSNAMRHGMPHVPSEDMDMTTKTVTENMSSTEAIQTPKKIWITAFIFAFFTLLCDGADLGFLALSLTSLKAEFHLTGVQAGTLGSLTLFGSAVGGLIGGWACDRFGRVRIIVFFIAFSSILTCALGFTHSYMQFAVLRTIGAMGLGALYIACNILMSEMVPTKHRSTVLATLMTGYTLGSLLATLLAGHIIPEHGWRFLYWIAITPVVLSVLMHFCVPEPESWKKARQLKALEVAQSNQPKKRQNPYLEILRDKKHGTMFILWIISTGALQFGYYGVSNWLPAYLESDLGIKFKEMAMYMVGTFLIMMFAKVIAGIVADKLGRRAVFAFGTIGTALFIPVIVYLNTPTNILWMMLFFGFLYGMPYAINATYMTESFPTSIRGSAVGGAYNIGKVLSIFSPLTIGYLSQNGSIGLGLLVMAAAYFICGVIPLLFIKDRLFNPQKAE

SEQ ID NO: 6713 - protein, 534 aa, Acinetobacter baumannii
KNNSSVVKENVMTSQFKKQLSLMDLTFIGLGAIFGSGWLFSASHVASQAGPAGILSWIIGGFAVLILGIIYCELGAALPRAGGIIRYPVFSHGPLQGYLLGSVTVIAFSSLIAIEVVAAREYAAAWFPSLTAVHDGVRSPTTIGWLFQFALLCVFFALNYYSVKTFAIANNLISALKFAVPVLVMVALLYHFKPANFSMTEFAPMGAHGVQGAVSAGGIIFAYLGLTPIISVASEVKRPQFTIPFALILSVVLATIIYVVLQVAFLGAVPTDMLANGWSGLSDKFPLPYRDIAMLLGLGWLALLVVSDAIISPSGCGNIYMAATPRVIYAWSNSNTFFRIFTRVDPKSGIPRYALWLTFALSVFWTMPFPSWDKLISVVSAALVLSYALAPVTVGALRRNAPELERPFYVKGFTVLGPLAFVIASFIVYWSGWNVISWLLGAQIVLFALYVIFKRYVPTQEVSLAQQLKSSTWLLVYYILMILASYLGSFGDGASHLLAAPFDTLFVMVISLGCYYWGIRSGLPKALIKNDDEA

SEQ ID NO: 6714 - protein, 300 aa, Acinetobacter baumannii
KLNRGSLDMENTTNQYPSEVPAQVQPHQPGDQEKMHPEPEIIKASHKGSEKLKGKVAVISGGDSGIGRSVAVLFAREGADIAVLYLEEDQDAEITKQLIEKEGQQCLLLKGDISDPDLAKQNIDKVLQHFGKINILVNNAGVQYQQKEIESISNEQLEKTFKTNIFAMFYLTKEAIPYMEEGDSIINTTSITSYQGHDELIDYASTKGAITSFTRSLSNNLMKQKKGIRVNGVAPGPIWTPLIPSSFDAETVEKFGKDTPMGRMGQPSEVAPAYLFLASDDASYITGQVIHVNGGQIVNG

SEQ ID NO: 6715 - protein, 301 aa, Acinetobacter baumannii
NENRMHTILGYLWQYITNPKAIIALSLFVALMSSYTSIPRHIFWALASAYALGLIAYGIYWLIQRKKHAVQGEELAQAIEKDTQAEYGKNKDKEELQLISQQMKESIQLIRKSKLGDKKGNAALYELPWYMVIGNPAAGKSSAIYNSGLKFPFEETHQKMVSAGLSGTRNCDWFFSTEGILLDTAGRYSVYSEDHSEWLGFLNILKKNRSKAPVNGLILIVSIAELVSQSPEHSLKLAKNLRARIQDLTERLEVVVPVYLVFSKMDLIAGFTEFFEFYEAQEYNQAWGATLPYEQNLLIMP

SEQ ID NO: 6716 - protein, 607 aa, Acinetobacter baumannii
MRSSVLKNLWTIQDWKTAYQNGQIHLADLIGYVAEIKNDDHAWIEISSNEQIQAQIDVLKDQNIADLPLYGVPFAVKDNIDVAGFHTTAACKEIQYLANQDATVVAKLKKAGAIVVGKTNLDQFATGLVGVRSPYGAVKNSFNPEYISGGSSSGSSVVVANGIVPFSLGTDTAGSGRVPAGHNNIVGLKPTKGWFSTTGLIPACRTIDVISIFALHIDDAWTVASLMQGYDETDEYSRIHPANVPTQFSKQKIAIPAQLEFYGDIESEKAFLVAVECVKKLGYDVESIDFSAFNELAAALYNDAWVAERTVAVERMTTREKAHPVIAQIIAQADKFKATDALQAEYNRAVLARKINLALQPFDALMVPTAPTIYTIAEVEADPLTKNAHMGGYTNFVNFADLSALALPNVLREDGLPSGVTFIAPAWHDQALANFAQLWQTETSLSLGKSTQHYQKSLEIQSNHSVQLAVVGAHLTGMPLNFQLTSRNATLLKKTQTADAYKLFALKNTTPPKPGLQCDAAGTSIEVEVWDVPLANFGAIVAEVPAPLGIGNLKLKDGTWVKGFICEAYAIQDATDISHFGGWRAYIQSLNQTAQSVVSKNVGEVSI

SEQ ID NO: 6717 - protein, 465 aa, Acinetobacter baumannii
PSWLGSFKEIFTVGLFMITSSYFKKHKKNYRSLKDQQLTIAAKANIFICIIFCLFWTIYFAFAQMWVIVYMDICFTLISIFSFFLIYINRISAGILLSQAVLLVFPVVFCLFFDVATPDRPRVAHLFLPAGAILGYLNYRREPSFLQIVLILLSIGCFIFFSGSSFTLDSAIPLSEDIRDHGGWIATCVATLMICISIYTMQLEIQIESSMEHNLRLALTKQQFELFYQPQVNSSEKLIGAEALLRWHHPVLGYIPTKEFIPAAATFGLMPEIGEWVLAQACKVLQDWSKKEETKDLTLSINISADHFMQSNFEHTVIGLVQRYDFNPSRLILEITENIALNNCASMIEKMHFLSKHGIQLSLDDFGTGYSSLSYLQKMPIKQIKIDRSFVQAALDDKRSNKLVTGIIKIGLDLNLRVLVEGIETAEQFSAFKSNGCTEFQGYLWGCPMSLNEFIKQLPIKTDKE

SEQ ID NO: 6718 - protein, 195 aa, Acinetobacter baumannii
IMVSTNFLIFEESMHQSLNLKRSSAFLKQAAVITFVALSSASTFALPSDRNQQISLVADRATYNEKTGLTTYTGNVVIEQGTMKLQADSIVATLNSKREIQTITAKGRPSKFQQQISADKGIARGEGQTIVYNADTGIITLSGGAYLYQDGSSIRGNTLKYSMNKGDVEAQGSSSNRVQIIIPPSSSKSFPGARD

SEQ ID NO: 6719 - protein, 411 aa, Acinetobacter baumannii
SIYSPTKTSEPRGQFMSEQQQELTRSMNVSYSEPQLPRASLVIWIVGIGLVIFFIWAWFFKLEEVSTGTGKVIPSSKEQVIQSLEGGILTKLNVQEGDIVQKGQILAQLDPTRFASNVGESRSLLIAAQATAARLRAEVNGTPLVFPEIVAQDPKLVHEETALYESRRADLEQTLSGLRQALQLVQQELAMTEPLVAKGAASEVEVLRLRREANDLQNKMNDARNQYYVKAREELSKANTDTQTQQQVVMGRNDSLQRAVFKAPVRGVVKEITVTTHGGVIPQNGKLMTIVPIDEQLLIEARILPRDIAFIRPGQEALVKITAYDYSIYGGLKGKVTVISPDTIRDEVKQDQFYYRVYIRTDSDKLYNKEGKAFGITPGMVATVDIRTGEKTVLDYLLKPFNKAKEALRER

SEQ ID NO: 6720 - protein, 80 aa, Acinetobacter baumannii
AFHRPLIHILQHAIYYQLTLKLLSISLTHLSPLIESNITISAIGIYNNFKKNLTVLTHFIKERLLEILRVSVNNGPLKNY

SEQ ID NO: 6721 - protein, 353 aa, Acinetobacter baumannii
GFRSMQFKPLGHTGINLPEICLGTMTFGEQNTQQEAFEQLNYALEHGLYFWDTAEMYSVPPKPETYGATETILGNWFAQHGQRDKVFLASKIAGPGFGGTHIREGHTKFNSEHISQAIDGSLKRLQTDYIDLYQLHWPERHTNFFGTLAYGNQQAQNDYDTTPLEETLLALQKEINRGRIRYIGLSNETPWGTMKFLQLAENLGVSKFVSVQNPYSLLNRTYEIGMSEIAKYEGVGLLAYSPLAFGYLTGKFRNGARPANARVTLFPRFSRYSNPQSEWATEQYAQLAEKHGLSLTQLALAFIKQQFFVTSTIIGATNLDQLKENIQAFEIELSPEILQGIEAIHIQQPNPAP

SEQ ID NO: 6722 - protein, 189 aa, Acinetobacter baumannii
KGRLFLLMDTRVLYIVAVVVAAVSGGYYYYSGKAKKLDIGSAKNMTYSAQGVHLTQTDDKGNLYIRAEVRQLEQDMQQKTSKLDQLNATMYKLGKVDATFFAKQAYGYDDNQKVVLSGDVVATKLAPQGTIEFQTDELTGYPKTRDIETNHQVTVQSPQGEFVSKGLKANLNNGQYEFFNIRGKYAPKS

SEQ ID NO: 6723 - protein, 160 aa, Acinetobacter baumannii
MARLNKRVKLYIVRSLATYETPSETARGVQEEFGIEVTKQQCEAYDPTKKTGQDLSEEFKAEFYRVRKEMNDNLSAIPIANIAYRLKRLQRFIDLEQFKENPVIVPSLMEQAAKEVGGLYTNRKEITGAGGGPLQSENITQVVATPEQIRQVLDELKGKY

SEQ ID NO: 6724 - protein, 77 aa, Acinetobacter baumannii
SCLSLNSVPLIACRIKLIRQFKFSIMSSVNNFSFLIFLYTVSAIAKYLGILISPYNYASFEPRSEKAALYGIMINLM

SEQ ID NO: 6725 - protein, 670 aa, Acinetobacter baumannii
QQLRTIIMFEKILIANRGEIACRVIRTAKKLGIRTVAVYSDADANAQHVKLADEAVYIGQSPATQSYLQVDRIIQAAIDTGSQAVHPGYGFLSENDQFALACQQHNICFIGPPVDAILAMGLKATSKALMEKAGVPLTPGYHGTNQDADFLKQQADRIGYPVLIKASAGGGGKGMSLVERSEDFLHALASCKREAKSSFGNDDVLIERYVIQPRHIEVQVFGDTHGNYVHLFERDCSVQRRHQKVLEEAPAPQMPSEKLDAMRQAAIDAARAVNYVGAGTVEFIVEQDGTAYFMEMNTRLQVEHPVTEMITGEDLVEWQLRVAYGEPLPKLQNELQIHGHALEARIYAEEPEKGFLPAIGKIDYLHYPTQNQYVRVDSGIVEGDEITTYYDPMIAKLIVWGKNREAALIQMQNALSQFHVDGLGNNIAFLEKIVRSESFKQAKLDTNLIQREQNFLFSPEEIKPELVVAAAFIEFLSKLNNNSSSQKQLWQAQPLWRLNIAYQHSIKLNYLNQNIQIKFASNEDGFTAEYNGQSYPISGQLIDAHTASVQIGGTQQKLSFNQSQQGITLFQNGQSYKFAYICQDFNQADSQADEGHLKAPMPGVVTQVLVSANHSVKKDDILMTLEAMKMEYTIRAPKDGVIVDSYFQVGDQVKAGDELVEFQPAQEEVA

SEQ ID NO: 6726 - protein, 516 aa, Acinetobacter baumannii
RALSMTDLDLSRARIAVIGSGTMGIGIAQLAIVNGHSTILYDLDAQKAQQAAQGLGQTFKKLVEKSKLTQQQADEALARLTVVNQIEALRDADLVIEAVVEKKEVKQSLFKQLAEICSAQTIFASNTSSISVTAISAGIAHPERVVGLHFFNPAPVMKLVEIVQGLKTPNSLCLALKDLMLNWKKIPVITKSTPGFIVNRIARPFYAEGFRALQEQVTSYDQLDYALKQCGGFAMGPCELTDLIGQDVNFSVTQSVYQEFFYEPRYRPSLIQKELVDAGAWGRKSKQGFYSYNEKNQYETFQPQAVVAKPIDAHIQLKGTWSQLPAFLTRLGLKSGSASDDNILQIDDIDLRLSQGESANIHYLSRKMVLMDWHHDFEQAEALVLSHNELCEASDLAKVEAYFAQFGISVMWIKDHPALLTLRTIALLINEACEASLHGVASLEDIDNAMKYGVNYPKGPYQWLTQMGGAYVLQTLNNLYALYGEEKYRASIYLKQYVAKTQNIATQYSRDMTEFA

SEQ ID NO: 6727 - protein, 82 aa, Acinetobacter baumannii
LFIRSYRIFCPVPSFPVDRGDITITLSTFIAHYLFMASAVHVFLQMNKILQTFIFQGFSTPFGYWRAVSQIGYHFTCELTNA

SEQ ID NO: 6728 - protein, 497 aa, Acinetobacter baumannii
SMISKSMEGIIMEQSTLKEYSGSATEHMELIFSKQRANFEADPYPSLEARRTKLHQLKKQIIRYQDALAAAINSDFSSRSLDESKLLDLLGSVLEADHAIHHLRRWMRPSKRRTELLFLSNRLSVQYQPKGVVGVIVPWNFPVYLALGPLIAALAAGNRVMIKLPEITPNTNAMLRRMLAEVFNEDEVAVFGEEITDPARFTSLPFNHIVFTGSPAIGKVVMRAAAENLTPVTLELGGKSPAIVSRNYPLADAAKRITHGKATNSGQICVAPDYALVPKRSIDEFVDAAKSSFIKMFGQNITNNENYTSIVNDRHLKRIQDILTDAQEKGARIIPCDTYSFDQQGRRMPVQIVLNCTPDMRIMKEELFGPILPVVAYDSLDDAITYVKSDERPLALYCFTHSSVERDRILRETHSGGVTINDWGWHVVNHDAPFGGIGNSGMGSYHGEEGFRELSHAKTVFIRHRFFPTQLFHPPYGTFLQKLSIRFFLKKGDPSIK

SEQ ID NO: 6729 - protein, 156 aa, Acinetobacter baumannii
GEIRMPRYLAIADTVYKKIKNEKLFTEDMIENLNCLISLIRQAIKGTEFKLKHDYINFEECLTKPLADCTVKLDLSLMPNFKNEDEFVLWLAGFIEKITIGGKPKFPPISQMIPKDFVFTKETFPVTPTPKKEENAEMIINYFKSEDYLKKTKISS

SEQ ID NO: 6730 - protein, 863 aa, Acinetobacter baumannii
GITRMRFEKFTNRLQQALSDAQSLAMGKDHTAIAGIHILSTLLEEPSNISLLQQAGARLPELKQKLEQALKDAPTIANPTGDVNLNPEAVKALNLADRYAQKAGDEFLSTDWVLLGLAETGETKNILSAVGVTPDSLRKVIENIRGSDKVMSNNHEDQRDSLNKYTIDLTERALSGKLDPVIGRDDEIRRTIQVLSRRTKNNPVLIGEPGVGKTAIVEGLAQRIVNGEVPEGLKNKRVLSLDLGSLLAGAKYRGEFEERLKAVLKDLAKHEGEIILFIDELHTLVGAGKGDGAMDAGNMLKPALARGELRCVGATTLDEYRQYIEKDAALERRFQKVLVDEPSVEDTIAILRGLKEKYATHHGVQILDSAIIAAAKMSHRYITDRQLPDKAIDLIDEAASRIKMEIDSKPEALDKLDRRLIQLKMQLEAVKKDEDAGSKAEVTHLEKQIAEVEKEYNDLEEVWKAEKTLVEGTKQAQVELDKARIAFEKAQREGDLAEAARLQYGVIPELQKQLEQDEVAEENEEPKLIRTKVTENEIAEVVSAATGIPVAKMMQGEREKLLHMEEFLHDRVVGQDEAVVAVSNAVRRSRAGLSDPNRPSGSFLFLGPTGVGKTELTKALANFLFDSDDAMIRIDMSEFMEKHSVSRLVGAPPGYVGYEEGGVLTEAVRRKPYSVVLFDEVEKAHPDVFNILLQVLDDGRLTDSQGRVVDFKNTVIVMTSNLGSQDVRELGEGATDDEVRTIVMNAVSQHFRPEFINRIDELVIFHSLKKAQIRGIADIQLDRLRSRLVDRDMSLTVDDSAFDLLIDAGFDPVYGARPLKRAIQQQVENTLAQKILSGDFVAGDTILVKGENGHLVFDKLKLS

SEQ ID NO: 6731 - protein, 100 aa, Acinetobacter baumannii
RVTRMFFLYRFVLVSLLTIGVLNLMGCRPMSKNEFNTRCVWAGHDLSACNCIYNSLEQHYSPQFVESLPKLSLQNIDAKMNFVETMNQTMQQCQLSASKH

SEQ ID NO: 6732 - protein, 161 aa, Acinetobacter baumannii
STTRRIKMNLDFTTIEKQAKLLKEEQEKLEQQDHDFQLALDKHRESLKNLFKELFHDREIKTENGGQFCVVFGDFKISLLIETAKFENGVPVKLNSVNPIIVKFKKDKPVAKAQFSDATQYLDSGFETPHYQYYYKHDDKTQLVQFSELPVFFQTILDAEV

SEQ ID NO: 6733 - protein, 227 aa, Acinetobacter baumannii
KGTSEMINKITSDIEPILKAIPDGATIMTGGFGVTGQPAELIEALIDLGKKELTIVNNNAASGDRGLTNLIIAGCVKKMICSFPKSAGSTVFQDLYRAGKIELELVPQGNLACRIQAAGAGLGAIFTPTGYGTKVAEGKETRTINGKNYVLEYPLEADFALIYADKADRWGNLTYRKAARNFGPIMAKAAKTTIVQVNDTVELGTLDPECIITPGIFVQHVVKVGDI

SEQ ID NO: 6734 - protein, 60 aa, Acinetobacter baumannii
RKARCNHRYRIFSKKYNRWVGVITSSLIKFFFKFMTEKRLKYGESRSMRGTYKNYFYIVF

SEQ ID NO: 6735 - protein, 476 aa, Acinetobacter baumannii
IPQREIKDMSQNENSNNAFAIESHSIDYVAPSERNGKVRDLFTLWFCTNIAPLAVITGAMSILTFNLNIVSALLAICCGHFFGAAILALTSAQGPQVGIPQMIQSRAQFGRYGALLVVLFTTLIYLGFFISNIILSGKTLHTVVPAIPVPTATVIGAIAATTIGVIGYHFIHKFNKIGTWFMGGSLLIGLMIMVPHINADVLAKGSFNMKGWFAMFGLCAVWQISFSPYTSDYSRYLPKSIGIYKPFIFTYLGASLGTIFAMAFGTIAVSIGSTTDAMEAVKSGTGLFGYVLMILFLCNIIGHNAMNLYGAVLSCITSIQTFAGQWMPSRNIRVVLSIIVLVLATLTALWASSNFISFFLNVIFALLFILVPWVSINLLDFYVVNKKSYDIQSIFARDGGIYGKFNAKALTAYFIGIAVQIPFLKNAFFTGALADVIPDADISWVIGLVVSLVVYYVFNLGKIKCSAPALNAKLPQ

SEQ ID NO: 6736 - protein, 113 aa, Acinetobacter baumannii
SEQSGLTRFMEKFEEIKMEDKNNWSLYEVFVRSKQGLSHRHVGSLRAPDDEIALQHARDVYTRRNEGISIWVVRSELIKSSQPDEKAEFFDPSLDKVYRHPTFYHIPDGIEHM

SEQ ID NO: 6737 - protein, 160 aa, Acinetobacter baumannii
LEQRMELDRFDKQILEILSHEDLNLNELSERINLSVSSVHRRIKHLIEANIMGQLKREINFSKLGFTLHILLQVSLSKHDSETFDKFLSEIEAIPEVTNAFLVTGQSADFILELVARNMDDYSEILLRRIGKIDNVVALHSSFVIKEYNVFNCYNLLNKV

SEQ ID NO: 6738 - protein, 209 aa, Acinetobacter baumannii
KYKSLISIEEIKMSLTTPVELLGEHVILKPLDVTQAEALKEAVCDGELYNLWYTRVPRPEQMTAEIERRLDLQKAGSMLPFYIEDRKTGRALGMTTLMHIEEAHRRVEIGSTWYRKSAQRTPVNTECKKLLLAHAFETLNCIAVELRTSSLNVQSQAAIVRLGAKLDGVLRSHQIVKDDILRDTHVYSILKHEWPAVRQNLEWLLNKPR

SEQ ID NO: 6739 - protein, 180 aa, Acinetobacter baumannii
KLERLSIVAEFNSIVPKCLIRQFDMFKSKTRLVYIAILSASVFILQGCDNGNQSSDKKVEIKPAPKLTNDATVYAKKAWTLINTVDHLVYEKQLSQINDNVRKPLRQLSTDWRINVKMTDSVTEGKYALCRKALTSLDVWARETLENNSSVTQKQADYERDKQQCKEAIENPNLGNTSPK

SEQ ID NO: 6740 - protein, 222 aa, Acinetobacter baumannii
IRRSIMTVLQSFEKAVLNEVCPAGEAWMCEVKKGQYFRIIDLEGNQAVDTLFMSAENPTERYSAMDTLAINQQIYLEKGTKLYSNLGRPIAVIHDDNCGRHDTIGGACSCESNTVRYAHETYPMHSCRNNFMYALAKHPIAKKHGLNVRHIGPNINFFMNVPVTPDGQLKFDDGISGPGKYVEVRAEMDLIVLISNCPQLNNPCNAYNPTKIQLVVREAEGV

SEQ ID NO: 6741 - protein, 64 aa, Acinetobacter baumannii
VLMSKFKAGDVVELNSGGPVMTILEVKNNGWVVCEWFDKNHTYNKKEFLESNIDTYEMLEAFTI

SEQ ID NO: 6742 - protein, 162 aa, Acinetobacter baumannii
YVMRDLLMSEISLDNFDYAILRILQKDNKTSHREISEKIGLSAASVQRRITRMEEKEIILKNCAILNPLKFGEKITSIIEVRLSEDRSVVMDRAKLYFASVEEIQQCYFVNGGVSFIIIMLSNNLSHFESLVRKHFADNEDVKTYRTLIVLDRVKVNFELNI

SEQ ID NO: 6743 - protein, 74 aa, Acinetobacter baumannii
KFIFKNSYIILNENYIDCLAHFYFEVYLNLSFTLTSLYYLLNFHIFLSLFNSKKPTFINKVGFYKLINLRLLQL

SEQ ID NO: 6744 - protein, 444 aa, Acinetobacter baumannii
FKASHGERNTMKEIVLSDLINQQKVGPYQKFILATCLLLMIMDGYDIQSMAYAAPLIIEEWGVQKSMLGVVFSASLFGLFVGSFLLSSLSDRFGRRPILLISTFIFSILMLLTPHVGNIEQLTVIRFVTGIFLGGIMPNVMAYSSEIVPYQSRIFTMMVISCGYTVGAMLGGGISALLVPWGGWQAIFYFGGIIPLIIFFITFFKLPESLYFLSENSKNSSKILFWLKKFYPALTFNAEIKIINNTEVEVKKSPLELFKNQRAFFTYSIWIISILNMISLYFLANWLPTLAKESGLSLNQALLIGSTLQLGGTIGSVVMGLKIDKTGFYKVLIPVFLVAVISVALIGYSVSHIVLLFIIIFIAGFAIVGGQPAINALSASYYPVSLRTTGVGWSIGIARLGSVIGPLFGGYLSQFLVITHLFVIAAIPSLFVIIMLMIQAKYRS

SEQ ID NO: 6745 - protein, 441 aa, Acinetobacter baumannii
WTQSACLSDAVPARHESGNTIMEKQYDVVVVGAGPAGLSAAIAAAESGGRILILDNNPQAGGQIWRAGPIFPVPEMAQQKYQQIKAHSNIEFMFGAKIVAAPFAGQLLVERPHDSLNLSYRQLILCTGARELFLPFPGWTLPGVTGAGGLQALIKAGTPVKNERIVIAGSGPLLLASADTAKKAEAQVLYVAEQAASSSVRKFALQLWRWPSKVIQALSLPHRLYQPDSYVVEAIGQERLERVRLQTPKGIIEIECDRLACGFGLVPNTQLGQLMGCQIKDNAITVDDYQCTLQPQVWAAGECTGFGGSELAMVEGSIAGYAAIGQNEKARQLFAQRQRYRLFAHLLEKSFKLRAELKTLARPETIFCRCEDVTFDKVAERNSWIDAKLHTRCGMGACQGSTCATAAACLFDWQLPNSRPPLLPTRVKSLMAMSTSPLNQK

SEQ ID NO: 6746 - protein, 1260 aa, Acinetobacter baumannii
VYESWLAEIDMNTMDTFHQMDKSHQGYITEFNDKSEFEQRINTAWRRAEPEAVEELLQAAAVSDDLDHKIYDLAFNLAHNLRERKTSSGKAGIVQGLLQEFSLSSQEGVALMCLAEALLRIPDTATRDLLIRDKINQGNWKEHVGQSSLMFVNAAAWGLMLTGKLMETPKQTSLSSVLTGLLARSGRGIIRKAVDVAMRMMGEQFVTGETIEEAVDHAKVLEDKGFRYSYDMLGEAALTDHDAERYFNDYTQAIHAIGKASNGKGVYDGPGISIKLSALHPRYQRAQIERVHKELYGKVFELARLAKQYNIGLNIDAEESERLEISLELLERLCFEPELANWKGIGFVIQAYQKRCFFVVDYIIDLAKRSQKRLMIRLVKGAYWDSEIKKAQIEGMDDYPVFTRKVHTDLSYIACAKKLLAAPEFIYPQFATHNAQTLATIYHLADPSKYYAGQYEFQCLHGMGEPLYEQVVGPREQNKLGVPCRIYAPVGNHETLLAYLVRRLLENGANTSFVNRIADKTLKVEDLIQSPIYDIRNAAKLEGSVGLKHPSIPLPLDMYGTLRKNSKGYDLANDTPLAALDSTAQELRNRIWQSHPLLANTDSLEQGHSVAITNPAQNDEIVGYVQEADLKHVEIALTAAEQTQSEWSNTPKDQRAQYLKRAADLMESRIQELMVLLCRESGKTYANAIAEVREAVDFLRYYATQVENLPANTVIQPLGTVLCISPWNFPLAIFSGQIAAALVSGNCVIAKPAEQTPLIAAQAVQILWEAGIPHGAVQLLPGRGETVGAQLSQDSRIDGIMFTGSTEVAKILQKTVAKRLSENGQSIPLIAETGGQNAMIVDSSALTEQVVLDVVSSAFDSAGQRCSALRILCVQEDSAATVIKMLKGAMQQLIVGNPAILKTDIGPVIDDEAKQTIDQHIQKMKSKGYPVHQLMFGATSQTELDKGTFVVPTAIELPNLDDLQREVFGPVLHIITYKYGELEQLISRINAKGYGLTMGLHTRIDETIQTVIQHAEVGNLYINRNIVGAVVGVQPFGGEGLSGTGPKAGGPLYMYRLMQHCSNKVLATPFAVKNEQTVFEGFTREVYQSLQNWAKQHLPQANREIEPFGVGKFYELQGPTGESNQYIILPRHRVLSIADTEQDQLHQLLAIFAVGSQAAVMPNSPLLAKHKQTLPKDVLDAITTIKNITTDDFDAVLHHGNREEIFSLQQEIASRSGAIVGITHVEPNESIPLERLVIERAISVNTAAAGGNASLMTMSE

SEQ ID NO: 6747 - protein, 404 aa, Acinetobacter baumannii
FAWRQSDMATLFKTLKNDWSISATVAGFLAVLISYSGPLIIFFQAAQRAHVSTDMMVSWIWGISIGAAVSGIYLSIKYKTPVITAWSAPGTALLVTLFPNISLNEAVAAYITSAIVIFLIGITGYFDKLLKWIPQDVAAGMMAGILFQFGISLFTASDSMPLIVFSMLIVFLIAKRLMPRYTMIWVLAAGVLLSLFLGKMNPVDVSFSLAIPKWISPEWTWNSTLNLAVPLILVSLTGQFLPGMAIMKLSGYDTPAKPIITATSIASLAVACVGGITIVLASITAALCMGKDAHELKEKRYIAGIANGIFYILGGLFAGSIVMLFSLLPKELVAALAGLALLGAIATNISVAMKNDSQRDAALITFLASASGMHFLGLSSVFWGICIGVIAHFILTPRSTPATN

SEQ ID NO: 6748 - protein, 661 aa, Acinetobacter baumannii
MMWRWTNIMTTQLTTSNLQGSSTGPEVTGANPPANFPDESTIARLANEFFLAVPSSSNSASPSGLNLDLPVGAPPHPPQPGEPFSALSGRAPNIAFQKSLNPEYPEHIPNLPDYPERRIVASAPVVGGAHLPRPPFEPHLPQAAHSEPNVPRIEPNLPTGADESPYYFLNDFSAPNATEPSVKGVEDNYSVAQSFQLPHGDQLKSLLTEDRFATSTPPQSSASSVFYFLDLPQSGQSYSHYQPSQPTFVASSAQPLDVHAIRRDFPILQERVNGRPLVWFDNAATTQKPQRVIDRIAYFYQHENSNIHRAAHELAARATDAYEHARNVVARFIGAPSSKEIIFVRGTTEGINLIAKTWGEQNIGEGDEIIVSHLEHHANIVPWYQLTKKTGAKLRVIPVDDTGQIILEELPKLINERTKLLSITQVSNALGTVTPVAEVIKIAHAKGVRVLVDGAQSVSHIPTDVQALDADFFVFSGHKVFGPTGIGAVYAKPKLLESMPVWEGGGNMIQDVTFEQVVYQPAPNKFEAGTGNIADAVGLGAALEYVESLGIHNIARYEHDLLEYGQNALSSVSGLRLIGTAHHKASVMSFTLQGYSTEQVGKALNQHGIAVRSGHHCAQPILRRFGVEQTVRPSLAFYNTTEEIDLLVSVLHQLTRNRRTS

SEQ ID NO: 6749 - protein, 476 aa, Acinetobacter baumannii
PYRRANMIKKILLSFIAIFTVVSGFIIFYWRDVQYNPNKSDFFLYFLLLPAIITLVILSPWLIYSVYKSYKEKKEQAANQSQDDDSQKPSAAIEQPLEQLDFNVYSAFAIHALGENETIIEEIQNFKSPELDEQLLNSYGLPLLSYRIKDLAETNDEDIQYAASPRQVRIMSLIRQQLEQNIENLYRLAEHLKRSILFYESHQIREYHMHPAWVDPNSEYEDAETPVVEVHRLNRLNLHIFLPEDLLHVWNDEQSNDLILEFFTEIGIISQKVHIEYHFLGERVAYQEFIHLLKRIQKKEHEVFLMLAVDSEIDQDLIDEKSWMVKDYIPAEFAASCLLADPSLKIEELEPAKNLKIVVGQEKAAKVLHTLNLNELPQYEGDEPYVLILSDQTDIKAAKQLQQQFAQTSVEPHHYIYVKSSLGHTQHLVDIYGFMLSMHFPEHIVPFVFGENTVSAHTFVQSVTENSEDDAMVLNS

SEQ ID NO: 6750 - protein, 215 aa, Acinetobacter baumannii
NIGSKKMVNTKQSNSDGNHTTHKEPSSNGYVSYSKPLQDISSTIDNARPDLNSPPTNNNYVPDMNEGGENLVATGAGTLGGAAVGAAFGVVGGPPGAVVGGIIGGVVGAIAGNDIAQTNNQKDDSNDWQEEDNYWRENYKKMPYYSEDKNLEYDRDYRAAYRLGYENRVHNNAEINFSEVESKLKAKWEQVKGSSRLQWEEAKFAVEDGLKKIHP

SEQ ID NO: 6751 - protein, 64 aa, Acinetobacter baumannii
EMTGVDISSLMSPTLKRTTSGLSKRSLQTGEPQVLQNTLFLFGDAKYACKRFSPCTISKSLFCT

SEQ ID NO: 6752 - protein, 240 aa, Acinetobacter baumannii
KTHGCTRFRLGRKIIMDFSLLHNPDVIAALKEGFIFTLTVTVLAMMGGILIGTPLAMMRLSNNALASNFAKFYVDLFRGIPLIQVIFIFYFLLPKIFEFQSDTYWGPLFSSVVTFAIFEAAFFSEIVRSGIQSISKGQVNAGYALGFTYGQSMRYVVLPQAFRNMLPVLLTQTIILFQDVSLVYVISAPDFLGRADTLANTYGPETKATFYLIVAVVYFCSSFVLSQLVKRLQKKIAIIR

SEQ ID NO: 6753 - protein, 493 aa, Acinetobacter baumannii
FFNGNVRTQPMQNVQLLIHGQSVDASNQATFERISPIDGTVATKAAAATLEDVDRAIESAQQAFKVWSKLSPTERRLRLLKAADLMDQKTEQFIETGMQETGSTATWYGFNVHLAANMLREAAAMTTQIDGSLIPSDVPGNLAMGVRVPCGVIVGIAPWNAPVILATRALAMPLACGNTVVLKASEACPATHRLIGEVLHEAGLGEGVVNVITHAAEDAPQIVERLVSHPAVKRINFTGSTKVGKIIAETAAKYLKPVLLELGGKAPVVVLNEADINEAVNAVAFGAFFNQGQICMSTERVLVQDNIADQFIEKLIEKTRSIQAGNPSSKDNVLGVLESRRAANRIQHLLEDAQNKGADLPLGIHIEDTTMQPTLVLNIKPDMLLYREESFGPVCTVQRFSSIEEGVALANDSEFGLSSAVFSQNISQALEVAQQIDSGICHINGATVHDEAQMPFGGTKSSGYGRFGSKVSVAEFTDLRWITIQTQSRHYPI

SEQ ID NO: 6754 - protein, 115 aa, Acinetobacter baumannii
IVDGGCMMNAYVRPHPDGFKSYLGKDQKTGLYTVRVGWTVYETNANGSVLYIVKEESKIPLDVEKFKTDRPKIYDALLNEVQFQRRKQLAIDLQKSNIPSYDRKAYKKRRGFTGS

SEQ ID NO: 6755 - protein, 112 aa, Acinetobacter baumannii
DLCGKVPMNKKHIIVSIIIGLIVGGLIGAFGYSKTVAKYDAISTACVMVNEAVENQLLTTEQVKTLGELTGTNLKKDYPTVASKFAFSPESLKKASEASNCSQFIVGFNQSK

SEQ ID NO: 6756 - protein, 66 aa, Acinetobacter baumannii
SMSGLYRLLKTRNGIKKARFRGSGLMFVDKGYQEHEESNKEFNASQKFPIYGNLLSQLFGQKREVI

SEQ ID NO: 6757 - protein, 500 aa, Acinetobacter baumannii
SYAGICIEANIMTADFQLYINGQFESGAATFESINPATGEVWAQMPEARTDEVNRAVQAASQALKASAWAGLTASQRGKLLYKLADLIEKAAPQLAQIETSDTGKIIRETSSQIAYVAEYYRYYAGIADKLEGSFLPIDKADMQAWIVREPVGVVAAIVPWNSQLFLSAVKVGPALAAGCTVVLKASEDGPGPLLAFAKLVHEAGFPAGVVNVITGFGPECGAVLSSHPDVAHVAFTGGPETARHIVRNSAENLAKVSLELGGKSPFIVFADADIQSAVNAQVAAIFAATGQSCVAGSRLLVEESIKDEFVQRLVERVQTIKIGLPHEMATEFGPLCTLRQRQKIEQVVASSIQQGAKLLTGGKSLERAGYYYPPTILDCTDVPQADCITTELFGPVLSVDSFKDEAEAVQKANSTPYGLAAGVFTTNLSRAHRMTKVIGSGIVWLNTYRAVSPLAPFGGHGLSGHGREGGANAVLDYTTTKTVWLRTSDEPINDPFVMR

SEQ ID NO: 6758 - protein, 282 aa, Acinetobacter baumannii
ADCGHERLEIKERKMSQSTGAPSLFDDGQIGTGGNNNSQSQVKLQAINLIDLLHDGFYLIFLIRNQYVPADPQRFREKILDLLNRFEQQAKKLQFSADDIHDAKYAFCALIDETIVTQQDPSYFNLQNSWLISPLQLSLFGSQLAGYQFFEILEQLRSRGKERLAALEVFHYCLLLGFQGKYRIESIESLNHLVARVGDEIDYLKGKKVAFSPFSAIPDQIRNIIHRELPFFWILIFLLIFALLTFAGLRFMLNNQNDKALSNYQNVISAPQEQAHITIYLP

SEQ ID NO: 6759 - protein, 322 aa, Acinetobacter baumannii
TFSGEKYCRLGDMVRWLISTTCKIQELVMMAQVQYQTLSDSQLLADMAVEALIDEVNLTPKPALVDRRGSGAHNDLNLDLMKRSAKSLRPMFEEMAQAAKHHGKVCLALREDIGEIGRQGEKTMMLATNGVNTHRGAIWALGLMVTAATLARTNQQYLSAVELCQLAGQIAQLEDRFIPEQALSHGQQVQKKLGILGAKEQAQQGFPTIVNFGLKQLYQSRSKPMKEEFARLDALLAMMTDLTDTCVLYRSGTNGLKRMQQGAQQVLDLGGSSSLEGRRALHLLEIDLLRMKASAGGAADLLAATLFIDRVEQSSAKNKKEF

SEQ ID NO: 6760 - protein, 282 aa, Acinetobacter baumannii
NFLGFTMILFGKKDQPSRNAYAVVTGAGSGIGRSFAVELAKRGGSVVCADINLGAAEETVKLIEQLGQKAFAVQCDVGQAEQVQTLADRAEQLLGHPVTLIINNAGVGLGGKFDEMSLEDWKWCMHVNLWGVIHGCHAFVPKLKKLGYGAIINVASAASYTAAPEMSVYNVTKAGVLALSETLSAELRKFNIKVNVLCPTLVPTNIIKNGRIPGRYSKLADHALMNYAMTTSDAVATLTLNRLDRGQLYTTPQIDAKLFWLMKRTSPTLYAKFLGLSYQLFK

SEQ ID NO: 6761 - protein, 191 aa, Acinetobacter baumannii
QKKGSFMPASTSQYYTRTAQILHWVMAIIFITAWVIGFYSGNFLSYDVDGSFKGDVITLHKNIATTIIFLVVIRLFWRYTHPAPQLPDTMSPTMKTLAHIGHLLLYVILVALPVTGCLFSWSAGHPAPVLYLFEIPRLVQDNPELLAIVKPLHIYISWFAGLLIVGHVLAALKHHFVDKDNVLNSMTKQPK

SEQ ID NO: 6762 - protein, 308 aa, Acinetobacter baumannii
TNRGNDHQGVLMKRSATSLIVSTVMLCTVGATSQIQAADTLAKIKSTGKIVIGHRESSDPISYVVAGKPVGYAVDICNQFANDIKKELKMPGLKVEYKAVTSSTRIPELLAGNIDMECGTTTNSKQRQQQVGFSTNYYATEVRMAVKANSGIKSLADLNGKAVVTTQGTTSDKYIKMNEKGQAINVQNIYGKDHADSFAMMASGRAAAFVMDDNILAGLIAKSSTPKAFAIVGPVLSSEPYGIMIAKDDPKFKAIADRTVNNLWKTGQVDALYKKWFLSPIPPKNTNLNMQQSSSYKKLKAHPTDAGI

SEQ ID NO: 6763 - protein, 234 aa, Acinetobacter baumannii
ENRGMKVVLKRSILILFLTGNIIGLSYAQAAELESVKLKKSCIKKNPLAEGQNDPELLNIFKQVCDSDNTTQKNDLLAKAAMRFYQTNQPVKALNLASQLQSQNIRGSLITDVLFLSGVSIANNSLQQMRNQEMRYLTNDITYPPAKQLVENIHTAMPAPDPSSFKTNNSESSSTDNEKRSYKKQYATRNKVSASRTSNKRVVSPAKATAVKPKTAPAATVNKSKSSPFDPLIK

SEQ ID NO: 6764 - protein, 347 aa, Acinetobacter baumannii
KCWGSFYMIKKALLSVSILSAVVLGGCDNTAKVPEAKQDAQAAANTKPITIGYSDWPGWVAWQVAIEKGWLKEAGLNVEFKWFDYSASLSAFSANQLDAVLVTNGDNLVTASGGTQGMMILATDYSAGNDVIIAKEGINTIQDLKGKSIGVEKGLVDHLLLATALTDHNIKSNEVKLVNSATNQLPQVFNSPDISAIAVWQPVAGQALKAVAGSKIIYTSKDKPGLIYDTLTVNMSHLTAHQEEWKKIIQVWDKTVKYINDPATHADAVKIMANRSGVDPKQYELMVSGTHLLDINANKKVFTKSQGFDSIYGSSYHVNKFNVENGIYKTEQNVDGLIYPTLIEQLK

SEQ ID NO: 6765 - protein, 392 aa, Acinetobacter baumannii
TMWGNNIKKDPAYQLTNIFIYYKLDPISDKESSQMFIKNAWYVACRPEEIQDKPLGRTICGEKIVFYRGKENQVAAVEDFCPHRGAPLSLGYVEDGNLVCGYHGLVMGCDGKTVSMPAQRVNGFPCNKAYAVVEKFGFIWVWPGEKALADEAKLPTLEWADHPEWSYGGGLFHIQCDYRLMIDNLMDLTHETYVHSSSIGQKEIDEALPVTKVDGDHVITERYMENVIAPPFWQMALRGNHLADDVPVDRWQRCHFFAPSNVHIEVGVAHAGHGGYHAPKDKKVSSIVVDFITPETETSHWYFWGMARNFQPDNAELTDQIREGQGKIFTEDLEMLEQQQQNILNNPHRKLLMLNIDAGGVQSRKVIDRLLAEENKTPPETSTQKFPNIRII

SEQ ID NO: 6766 - protein, 1207 aa, Acinetobacter baumannii
SGRGVSMFKKVLIANRGAIACRVIRTLKKLGIASVAVYSEADRDSLHVTLADEAFLIGPAPAHQSYLNIEKILEVAKQSGAEAIHPGYGFLSENAEFCDLCESQGIAFIGPTSSQMLDFGLKHTARELAIKSNVPLLPGSSLLSDEAEALFEAARIGYPVMLKSTAGGGGIGMRLVWNETELKDAFQTVSYLAQVNFKDAGLYLEKFVQHARHIEVQIFGDGQGQVLALGERDCSVQRRNQKVIEETPAPHLNEQQRDYLQKVAIQLMQSVNYRSAGTVEFVMDTETQEFYFLEVNTRLQVEHGVTEQVFGVDLVEWMVTLASGDWLAPTEKLEPTGHSIQVRLYAEDPIKQFQPSAGLLTHVKFDPQARVETWVETGSTVSSFYDPMIAKIIVTAATRDQAIQAMSASLANTQVAGIETNLEYLQNIIACNVFALGTQTTRFLNTFEWKTQKVEVLQAGIQTAIQDVTGRLGYWDVGVPPSGAIDPLSLTVANQLLANEPNTAGLECTLQGPTLKFHCDSQIVITGGDMPSKLDGELVPMWQTINVKKGQVLKCGIIRSGCRSYIGVKGGFDVPEYLGSQATFTLGQFGGHAGRNLLIGDMLPITEYSAQSTTALAQAQIPSFTQNWEIAVMYGPHGAPDFFTKQDIDTFFANEFEIHYNSSRTGIRLIGPKPEWAREDGGEAGLHPSNIHDNAYAIGAIDFTGDMPIILGPDGPSLGGFVCPAVVIHSELWKIGHLKAGDKVKFVPVSYAQAKALDQKYHQSLTATDTTRIDFNPIIQAEPDTLKDAVLATLEGDANLPSVTYRPAGNSYLLVEYGELVLDLNLRFRIHALMQWVIDQNIQGIIDLTPGIRSLQIHFDSIQLDQLELLQKLQQAEAELPDIQNMQVPSRTVYLPLAWEDSQTQLATERYTQIVRPDAPWCPDNVEFIRRINGLASKQAVKDVVYSANYLVMGLGDVYLGAPVATPLDPRQRLVTTKYNPARTWTPENAVGIGGAYMCVYGMEGPGGYQFVGRTTQMWSRYRKNANFEEGKPWLLRFFDQVKFYEVSETELLQMREDFKAGRLQLRIEDGVLNLKEYNEFLKTHQDSIQAFKDMQQANFEAERRRWHEAGLQEYISESLDTVDEGETVVIPEGGCAVESHMPGSIWKIECAPGDIVEEGATLAVIEAMKIEIPIIAPERMKVETITIEKGQTVKTGQVLFTLAPVA

SEQ ID NO: 6767 - protein, 487 aa, Acinetobacter baumannii
FTGGKFMSLGLTALELARIQFAFTVSFHIIFPATSIGLACFLAVLEWKWLRTQNPIYKDLFKYWIKIFAVAFGMGVVSGVVMSYQFGTNWSEFSRVAGSITGPLLTYEVLSAFFLEAGFLGIMLFGWGRVGPRAHFFATLMVAIGTCISMFWILSSNSWMQTPQGFAIENGIIVPKDWLAIVFNPSFPYRFAHMGAAAFLVSSLLVVGTSAWHLVKGRRDELVKKSFSMGLWMVLVTSCLQVVIGDNHGLNTREHQPAKLAAMEGHWETNHNEPMPLLLFAIPDMKEERNHFEVGVPYLGSLILTHSLDGQVTGLKEFAPEDRPNSTIIFWSFRVMVGLGVLMVTLSLIALWLRKRGKLYETSWFHKFAVVMGPAGYVAMLAGWITTEVGRQPWVVYGIMRTKDGLSHTVSADQVGLSLFIFVVVYTIVFGSGIYYTLKLINKGPVFIDTPNMEAGGVGHFKTPMRPLSAVDENIDSKQNSGENRHD

SEQ ID NO: 6768 - protein, 296 aa, Acinetobacter baumannii
IIIFAVRNKIWIGMTMNDAVDAEQTEKLLAPLRHELLHPIEDMQDENDRQFITALARGLELLRCFTPKHQHLGNQELAQMTGLPKPTITRLTHTLSRLGYIKQVPNSSKFQLSVGVLAFGYSMLSNVSIRSIAHPYMKNLADYAGAAVAMATRDRLNMIYLDVVQGKGNMTMRRQVGTYLPIHLSSMGRACLAAMPEDEREFLLNAIRNKHKEDWIKINRDLDKAFKDYQDFGYCFSIGEWHKDVNSVAVPLIHEQHGLLVFNCGGPSFIMNREKLEEDIAPRLLHMVNNIRTEIS

SEQ ID NO: 6769 - protein, 164 aa, Acinetobacter baumannii
HPFIRPQLSLRLIKMSERNQSRLLTVGEVAKRSGVAVSTLHFYESKGLIKSIRTNGNQRRFTLVVLRYIAIIKIAQKVGIPLDEIKQALSKYPMGSKLTAQQWKELSLDWRKNLDERIQKLTRLRDEMDWCIGCGCLSLEQCPLRNPNDVLGQEGAGPRILERP

SEQ ID NO: 6770 - protein, 398 aa, Acinetobacter baumannii
RLFMLQNTMHRQVLILASSQSLFQTVSVMVMTIGGLAGANIANTPTLATLPIASMFLGTALMMFPASILMAHIGRRNGFLFGAFLGVLGGIIASIGIFYSSLMLLALGTLCVGAYQSFAQFYRFAASEVANDAFRSRAISWVMAGGIVAALIGPTLARFGGPLFQHLEYIGSFLIISIISLVAMGILSNLHIADTVEQKSNFTAGRPWQQIVFQPTYLVALFGAITGYGIMILGMTATPIAMRHAHHELGSITTVIQLHVLGMFLPSFFTGNLIARFGVLKIMFAGLLLFVCYIGFALSGIQFTSFAISLILLGVGWNFLFIGSTSLLTGTYSVAEKAKAQAINDMTVFVVGLICSFSAGALLDLFGWKAMNMALIPWLLIAAASLFWLSQKREKQLA

SEQ ID NO: 6771 - protein, 184 aa, Acinetobacter baumannii
GIFMNYSLDSNFRLIDCNEAEHAAAILEILNDAIVNSTALYDYVPRSLDSMKTWFSVKRENGFPVIGVVDELGKLLGFASWGTFRAFPAYKYTVEHSIYIHHEHRGCGLSKVLMQALIQRAQQAQLHVLIGCIDATNQASIGLHEKMGFTHAGTFKQVGFKFGQWLDAAFYQLVLDTPFEPVDG

SEQ ID NO: 6772 - protein, 82 aa, Acinetobacter baumannii
VDFITGIKMDICIGGILNGKVRKNNENYFSIGNPHSDDVTEYHKQYFHLDGKLLSFWVCNEINFQEAFRIAESFFKKEQSFY

SEQ ID NO: 6773 - protein, 73 aa, Acinetobacter baumannii
ELFMSKDFKALTYIADDNIADTVTWLLHHQDVFETFHFDVLSQELSVTHAAGRDIIRVGTFLNATYGILVTSV

SEQ ID NO: 6774 - protein, 402 aa, Acinetobacter baumannii
AQFMKDIYRFKVGDFAPSESTRSFTPEGYLKCVNVRLGKAPQVRQYYAYEFPNLEGFSADQTINVYTPAEELFKPNPIKSWDGADATDYHPPKNEINAANWKEYHIGYCENVRQEGEYLVGDLLIKDKDSIDLIQNNERLEMSLGYGATLVLEQGLAPDGTVYQAKFINFIGNHVALVKYGRCGGDCRIGDKQQTPPKGNKTMEVIVNGIRFNIGDNTPLADALKQQQEQLENMKAAKLKVGDKQFSIGDELGAIQAVVDQLHTDKTTLEQKVGDLEKNQMTPEKLEQAAAERTAVIADAKALVPTVKTEGCTCEQIKRDVIAAKAGDALVTALLGSVSVGDAKPDQIDTTFRALSAVKGTHPSNPVGDALHKQQNIQAGDGKPEDGEPKPNNKKEAWKQSF

SEQ ID NO: 6775 - protein, 273 aa, Acinetobacter baumannii
KMFITSQLNITHKIIKNQSISTLVIDQLEQTYVNLEATLLRAKVLRDFSKTQTVYLIQSHIEPQQSSLAYLFSPFIFANLNKAAIYTTPATPPALNILNKYYQADKKVVFKVDEVLESLKIYLDLELIEMGGAEFIYLNLIKALCRSDISTVFLITHLELDLEALKQLEQFLKIKIHWVKVVKNEGLKGLDQLDMRKLLFKNKDETHVQLCALFAQMNAALVGLCDTFTVNQMTHLIDDMFYSEHIFEKLSVYSEYMQTLLQSQHSLNKKQIA

SEQ ID NO: 6776 - protein, 896 aa, Acinetobacter baumannii
FLLIGRPIFMINTSPLLNYVSSHHDIKAINQWRTDVEKQLQDSYENGQSIREIIKARSDLVDEALVFLWKHAELDQSKLGLFAVGGYGRREMLPYSDVDIMILSEDEISEENEKRISTFISSLWDVGNFKPGISVRTIQSCVEQAATDLTVATTLIEARLITGNTQLAKWPRRIVSQTWTDKTFYDAKMAEQAKRYHQHNNTESNLEPDIKNAPGGIRDINQIGWIAKRHFRVNRIYDLVHLGFISEFELAVLEEAESFLWEIRHHLHRLAKRDENRLLFDHQREIAAKFGYVRQEGQPVNYGVEQFMKRYYRTAQQVSTLNEMLLAYFSESVITPRLPNYERKIEVVNDHFKIVDNKLAVQHHKIFAEHPSAILELFYILANRPDIEGIRARTLRLLILAAKRINQSYRDNPEHQALFMSIIRSPYRLYDTLVAMKRYGVLGNYIPAFGQIMGLMQYDLFHIYTVDAHTLLLLRNLNRFREPEFAKEFPVVSSVFQRLARQDIVFIAALFHDIAKGRGGDHSELGAEDAIEFGRAHGFTERECKLIAWLIQNHLLMSLTAQKKDISDPDVVKDFAEKLGDMEHLDYLYTLTVADINATNPKLWNTWRASLMRQLYTHARDVIRTGLGRPVDYQMLIEDTKFAASELLVNNFALADVEKVWQELGDEYFIKESADEIAWHTQAILKHGDNPEPLVLLRAHRKAAQDAVQIFIYTRDQPNLFATTVAVLDRMNLDVQDAKIITASTAFSLDTYVVLDRFGTLLTDPEREETVKNALVKALSQPDQYPGLMQRRIPRQLRHFDIENTVDVTLNEALQQNMVEISTLDHPGLLARVGGLFMMQGLDIHSARIATLGERAEDIFFVTKKDGKPLNNEEVKLFSEKLKAALDEASNQICQH

SEQ ID NO: 6777 - protein, 442 aa, Acinetobacter baumannii
RLLMAAPNSSAGWLERLFKLSDNKTTFRTEVLAGVTTFLTMCYIIIVNPLILSETGMDHGAVFVATCLAAAIGCLVMGIIANYPIALAPGMGLNAYFTYSVCMGMGVPWQTALAAVFVSGVVFLAISFFKIREAIVNAIPMSLKFAIGGGIGLFLALIALKNAGIIVANQATLVGLGDIKQPTVLLALFGFLLIVILHQLKVRGAIIISILVVTAIATALGLNEFKGVVGEIPSIAPTFMQMDFEGLFTASMVGVIFVFFIVDLFDSTGTLVGVSHRAGLLQDGKLPRLKKALFADSTAIVAGAALGTSSTTPYIESASGVAAGGRTGLTAVVVAFLFICCLFLAPLAQSVPGFATAPALLFIGVLMIQGITHIDWDDITEAVPAFLTIVFMPFAYSIADGIAMGFISYALVKLFTGKAKTVPYMVWIIAALWVFKFIAFGG

SEQ ID NO: 6778 - protein, 300 aa, Acinetobacter baumannii
VLIMKQLLAWTIRTTLRPALSPKTPLKLQRFCSDAASAIVLGPRGYQTKKQIIAQVPTLHIRPKTIKSGRGILYLHGGGYVVGSSKSHAKLAAQVGHVAQAQVWLPEYRLAPEHPSPAAIEDIVAVYKALLAYGQDPKKLVIAGDSAGGGLSLSTVIALRDAGFPLPAALVLLSPWVDLSLSGNTIKTHAAQDAMLSEDWLTWCAKNYCGQKSATDPTCSPLYADLTGLPPVLIHVGTEEVLLDDAKRLAEQTEKYGIPTNLRVYDQVGHVFQFHAGILKESNDSIERIGQFIDKHIESI

SEQ ID NO: 6779 - protein, 65 aa, Acinetobacter baumannii
FFIMNKTDLNITQSETWLNAKFNFQSIRHRSVIMFKAMFFFSAGAMFGYCYKHYDEKVIESNKSK

SEQ ID NO: 6780 - protein, 341 aa, Acinetobacter baumannii
ESIMHIAALHQPSQVQLNQDGNLKHFLTIEGLSKENLTKILDTAQSFLDDNNNLINRPLLEGRTVMNLFFENSTRTRTTFEAAAKRLSANVLNIDIARSSTSKGETLRDTLWNLEAMAADIFVVRHSSSGAAHFIAKDVCPKVAIINAGDGRHAHPTQAMLDMLTIRRETKKPFEDLSVAIIGDIKHSRVARSDVAALQTLGCKDIRVIAPNTLLPVGFSEYGDHVRLFNNMDEGITGCDVIIALRIQNERIDSPALSSQSEFYRMYGLNKERLSLAKPDCIVMHPGPMNRGVEIDSSIADGEQSVILKQVTNGIAVRMAVLALSMQGQLQEQGLIEAIAL

SEQ ID NO: 6781 - protein, 314 aa, Acinetobacter baumannii
GIIMSNIFTGCIPALMTPCTPNREPDFDALVKKGHELIEAGMSAVVYCGSMGDWPLLTEAQRQEGVARLVAAGIPTIVGTGAVNSKEAVSHAAHAEKVGAQGLMVIPRVLSRGASPTAQKAHFSAILKAAPSLPAVIYNSPYYGFATRADLFFELRREFPNLIGFKEFGGAADMRYAAEFITSQDDSVTLMAGVDTQVFHGFVNCNATGAITGIGNALPKEVLQLVDLSKKAAAGDAKARRLAQELSSALEVLSSFDEGTDLVLYYKYLMVLNGDKEYTLHFNETDALSESQRKYVETQYELFRTWYRNWSAEI

SEQ ID NO: 6782 - protein, 155 aa, Acinetobacter baumannii
SVIMIQNETIEVSPVQQQDYTQWLEYWVAYQNFYQVNLPLHITKMTWDRFFDEKEPIYCAVAKNKEGILGFVTYMFHRSTWAENNYCYLEDLYVSPEVRGRHIGKQLIEYVQKQATEHSCERLYWHTQESNQTAQKLYDWIAQKPGVIQYRMSLN

SEQ ID NO: 6783 - protein, 499 aa, Acinetobacter baumannii
TRIMARMAKVVELPSIAKIDKSKGKISAQLTQALREAVQSGDLQPGDPLPSSRELALTLGVARGTIIEAYDQLLAEGVFDSQARTGTYVSHALAKKTTPQHSQKETTPSVIPLTKSALSYAQVLKEFKPLPHAPFAVSVPIARTQPSDIWRKFGNKFRSRGAGAPSGYGEPQGVLSLRVAIADYVRRSRSVHCEPEQIVITPGIQQSLYICSQILFEAKDEVWIEDPAYRGTTAIFEHTVQNIRMVRVPVDEEGIQVETGIKLSKNARAAFVTPSHQYPLGMPMSLARRTALLAWAKQQNAWIIEDDYDSELRYNGQPFPSLQGMAPDQVIYLGTFSKVLFPSLRLGYAVLPKELVAPFCGLRVLIDRHPPAADQHVLAAFIQEGYLERHIRRTRNVYAEVREYIIGLIEKYIPQELAWLQPGDQGMHMVLWLAQHINDIDVASSAVDAGIAIKAISPTFSKERRRSGLIVGLGDFEPELMQQAIKKLSKIIQQQAKSM

SEQ ID NO: 6784 - protein, 112 aa, Acinetobacter baumannii
GEIMRFIFLFISAISIQCYAASEAMELHYCETVKKAASGVMDARQHEVPAKELHDIANHLEEQQAKQLYQELIKSAYSSKLFEDPLIKSKAVENFQTTWHEQCLAKELAKNM

SEQ ID NO: 6785 - protein, 290 aa, Acinetobacter baumannii
EWIMPKKFEDFNNPRKKALAGMKQSISAELWDKNLNFLNQLRAKIAKHPVSHHPAIETLNNGEINKENLKRIHLEYRHAIVQTFTDALLMAQYQTKQLEPRLHAGAKMFPRCLLSLNIFDEFGFRPGTDKDGYYQGNPEYAHYPLFEDVLDDFEVTEEERQSYQPTEIAHQVREFLENSYKDYKAVSALLAVAEKEVILYSPPLRKATSAVGIAVEGGGYYHVHGVSEDETAEAADDDHEEDLWFILMQACTEEDYTYLENLCLEYCDLWEKFWDVQIENSKSILKQNLA

SEQ ID NO: 6786 - protein, 197 aa, Acinetobacter baumannii
RYVMKNKPWIEENDPLKEYYGLLDDNELSSFLSLFSEWNKNDYALESDIGQVKTGIQLLDFFDYSKESCHLPLFENSCSIMEGESEKLYWIPLSNNEDIIFQDFSPLMIAKTSITKETLDYVSRSFVQMINGGYIFIDSKCRFVGVVIDGYYMQVYMKKVFINDVMKPYVKNWEKIDEFLDPLLKKDLIDRVHRISR

SEQ ID NO: 6787 - protein, 319 aa, Acinetobacter baumannii
ANVIQLLEILRVSVNNGPLKKLLELQSEQANPESEKIHISFYALFEQYYQEEGRKMKSARLIVQILKCLKKNWGKLADESIHDLTPALVKQWRDKRLKQVKGATVIREMAMYSSVFDFARKELFLTKENPFKEISKPTAPPPRNQRIYQNYIDKVLAGLDYEWGKVPVQPRHRVAWSFLFALETAIRKGEILSVEKSLIFPDFIRLLDTKNGTTRDVPLTTKAKELLSWLPDDPDDNRMVPLTSNAFRLIWQRNLRRVGLDGVITFHDTRHEAITRFVHDYRLPVEILAKITGHKTISVLVNTYYNPTASEIAKMLTAA

SEQ ID NO: 6788 - protein, 1053 aa, Acinetobacter baumannii
FSPIKMLNSIHQVLDSLGISPQKRAIHVQFTSSILNAQVFLQRIDGVHALNDGLKAELLCLSTNATIQLKSFIGVQAAVDIVTERGELTRVTGIITHAQQGQSDGSLTLYKLTLEDPTALWKYRRNSRVFMNKSVVEIWEILFKEWQTKNPLFAASLSLDLSGLTQTYDVRPFVMQHNESDWNFLTRLLRSENISWLIDEAQHIVPSTETPIQAQKLRLIDANSQYQPLDRKTIRYHRSSAVEQYDSMTRLTAERSLQPNVMHIQRWQAEILDQEEGIGSVQSKHQHSEHYDNATLGLEQAWNYSPAWIGDLKGEDGVTKSGNQQVERLNQNLNNYYEAQAKRFIAQTTVRDAYVGYYFELNEHPEIDQHESTDRSFLIISKSFFNQNNLPKDLNDRINGLLAQSNWAIQNPENSDERQANQLILQRRHIPTTPAYNPQIHSPVTHPQRAKVVGPEGEEIYVDEWGRIKVRFLFTRSDDHSHDGGAGTNNNDTDSAWIDVLTPWAGEGYGVRFLPRIGEIVVIDFFNGDIDRPFVMGRIHEAQRQPTKFDNKGKLPDTKKLSGIRSKEVSGGGFGQLRFDDTPGQISTQLQSSHGASQLNMGKLSHPKDKAESEDRGEGFELRTDQWGALRAGQGLLVSTHKQDNAKGEHLDAEVAKKQLEGSQTNSKALSDIAKNQKTDEIESIEQLKDFASQIQQQIAKFEKALLLLSSPDGIALSSSEDIHISADAQINQIAGDSINISTQKNVIAHAQNRLSLFAAQSGLKAVAAQGKVEIQAQSDALDVLANKGITISSTEDCIEISSPKEIVITGASSQITLNGSGIFPKTGGKFQVNAGQHVFQGGASASVKSSLPPPPKRAQGVLELLHDYSHGAFVKGAGYTVTDNLGKVVNGKLDDKGFARVSGLATGSVKVLFDPDPRNPWDEASDFKRKVEWPNQNDVEGSIGIESGSKGLTETLKNDFKKLSQLASNVKSVQQKIESVKKIKDQGAKALLPMAMEQVLGGSHGSKLSQSFVSQNSFMPSSQQSNPLRRLAQASSDKTAITKIQSPFETFV

SEQ ID NO: 6789 - protein, 233 aa, Acinetobacter baumannii
NTPINIQVNLTMQQMWTDIDEYIDSHLIPEDPRLDFALKNTDEHGFSNHLAVAPNQGMFLQMLIQMNKCKRVLEIGTFAAYSTIWLGRALPEDGYLLTIEGRDTHAEMAQKNIDHANLPVKVELKLGRAADVLSAIDPQSIEPFDFIFIDADKQGYPEYLELSLKFSKSGTIIVLDNVIRAGDILNPENKKPSIEGIRETFKALENHPQILSCTALQTVGSKGHDGFAIAIVK

SEQ ID NO: 6790 - protein, 83 aa, Acinetobacter baumannii
FEFLISCKANVTLKSVNEILPKSNSFMVGSLTAFHYEGSDFAVYSTFRLHSSYDIYKSACHCLCAVCELKFLGERFFIDVRIS

SEQ ID NO: 6791 - protein, 485 aa, Acinetobacter baumannii
CNTIFVECLKTLMQPFVLYNSEQRKKVEFVPRKEGHIDMYVCGMTVYDYCHIGHARVMVAFDYIIRFLRSQGWKVRYIRNITDIDDKIIKRANENGETIQQLTTRFIDAMNEDAANLGCLAPDEAPKATEYIDQMQNMIGNLVNKGAAYPASNGDVYFEVTKFEKYGRLSGRKLDDMQAGASERVDVEVEKKHPFDFVLWKHAKENEPSWPSPWGNGRPGWHIECSAMSTCCLGNHFDIHGGGSDLMFPHHENEIAQSEASTGEQYVNYWMHVGFINVDGEKMSKSLGNFFTIRDVMEKFHPEVIRYFIVSSHYRSPVNFSDVALKEAKTSLTRFYHSFKAYQQVYGQTTTEALDQSFIERFNNAMCDDFNTAEAMAVLFELNKELNRAVKEEQADQATVLYSTLRHLTNILGLVQHNVDDFLKSDIGQDALALSDAEIEDFIQQRVDAKKAKDFAKADSIRQSLLEQGVVLEDTRQGTVWRRAD

SEQ ID NO: 6792 - protein, 62 aa, Acinetobacter baumannii
PNTMYTAFKCPCILHCIAQNVLESQYFVLIHPLNQVNKRLFCIQEIAIFSLTVFKDFRAAYV

SEQ ID NO: 6793 - protein, 150 aa, Acinetobacter baumannii
ERTIKGKDMPQYLKIAEKIYQNVKEKKGFTDDPMEDLNNLMIELRQEIKGTKLKLLYNYIDFAEILIKPLQESKIKLDLSLIPKSKNTQEFVLWLAGFIERITTGGQEKLPPIRAKITLPAYAYEETYPSQKKPVNNGEEIIEYFKKNQS

SEQ ID NO: 6794 - protein, 305 aa, Acinetobacter baumannii
KKYIDYRELKFQSFPPIVKMMIETNSKQGMAFAAAFLSLVSVQIGAAIAKVLFPILTAEGVTLTRLALSACFLWIVFKPWRQWNKQTNWKNLIIYGSILTLMNTLVYKAFSYMSVGIAISIEVLGPLTVAILMSKNKLDYFWGGLSIIGLLLLPMGNANNNFSFIGMTYALLAAVGWGLYVIYGSKVAQGGGSSVATGMFIAALFATPLGASHIIHIFDSYKILFTCLLMAMLASAIPFILDMIAMKKLHPRVFGILLSASPAVSALAGWLILDERLNSFQVLGITIIMASCAGCSYFSYKRNKV

SEQ ID NO: 6795 - protein, 270 aa, Acinetobacter baumannii
EVYMSYQFLQLEQQGQVAYVWLNRPELHNAFNTTVIEELHTCFKQINTRDDIRVVVLAGRGKSFSAGADLNWMKQAGQASSAENEADALKLAQMLDALATLKQPTIARVHGIAFGGGMGLASACDICIASTDAKFATSEVRLGLAPSTISPYVIRAIGARQASRYFLTAERISAREAKQIGLAHEVADAEDLDKKVQEIIDALLLGGPHAQAASKQLIQMVSNQTMSNDLLQQTAHHIAQVRQGSEAKEGLSAFLNKQQPAWISNSNNNN

SEQ ID NO: 6796 - protein, 366 aa, Acinetobacter baumannii
ATHIFLFFIIRPAAYHELILLKDHEIMSTKTKPLIITAIVVVAIVAFIVWQNKKDNNTSASVRDNKPVVIAYQTGVDPSKVVQANGDYEKHSQRTIQWKKFDAGSDVVNALASGDVVLGNIGSSPLAAAASRNLPIEVFLITSKLGASEALVVSNKSGIKTPQDLIGKTIAVPFVSTTHYSLLSALKHWNIPEDKVKIINLRPPEISAAWERGDIDAAYVWEPALSKAKSSGTVLTDSKQVGEWGAPTYDLWVVRKDFAEKNPDFLKAFVQTTLEQLEKYNQDPAAYVKDADNVQKIAQLTGSDAKDIPLLLSGNIYLDHAQQKQTLDGEFAQNIFDTAKFLKGQGKVDQLKADYKGNVNSSFLQP

SEQ ID NO: 6797 - protein, 278 aa, Acinetobacter baumannii
IMILFGKKKVKPSQKAYAVVTGAGSGIGRSFAIELAKRGGSVVCADINLEAAEETVTLLEQHGAKAFAMHCDVGNPEHVTNLAETAEILLSHPVTLVINNAGVGLGGKFDELSLEDWNWVMNINLWGVIHGCHAFVPKFKKLGYGAIINVASAASYTAAPEMTAYNVTKAGVRALSETLSAELRKFNIKVNVLCPTLVPTNIIKNGRIPGRYSKLADHALMNYALTTSDDVAKLTLNRLDQDELYTIPQIDAKLFWLMKRASPSLYTKFLGTSYKLFK

SEQ ID NO: 6798 - protein, 432 aa, Acinetobacter baumannii
KMIFIGRPSSVNVFWLNGQSVLKSDLLDKGLIMQIPSLLQSSLLGQNQKVELAGHLLSTLTTYKYPEHGPSVLEVVDIQKKFQHFQALTHINLDLKAGEFVSFLGPSGCGKTTLLRIIAGLEKPDYGKVIKKGADITLLSAEKRHCGIVFQNYALFPNLNVEENITFGLDKKKWDKAQRSQRVQQLLELIELPDIAKKYPNQLSGGQQQRVALARAITPNPDILLLDEPLSALDAQVRLKLRQKIRSIQTQLNLPTIMVTHDQEEALSISDRVVVMNHGVIEQIDTPHNIYYKPQTQFVAKFIGTMNFLKATCAVPNQLEVLGFIPLNLEQQKLKAGENYSIGFRPEAVELVDDFGSDKESLYLPVKVLSTEFLGAKRRLFCAIHIDGIEQAKHLLQIEIENTKFKSLQELMFIKVPNQLIHVFDEQGHALC

SEQ ID NO: 6799 - protein, 199 aa, Acinetobacter baumannii
DINMIKTFLFISVLGFSLTGCVAVPILAMQHGQPTQTLNNAAYDKQTQSRLRVYSQYANVNTYTNTSCNEWSSKKIKNYFNSVMTSLPNTETISVGMPATKDSQSILKTPQKGWGPKLTFKEVILEANKPVVLDARRVETTARYTCQVAVSFTPEAGNDYEAWYSENNDTCSIKFNKITENKTDNLYSTQDFDNISMCK

SEQ ID NO: 6800 - protein, 455 aa, Acinetobacter baumannii
KNNISMPRSILMATSTPLVKSIRAIPVAGHDSMLLNLSGAHGPYFTRNILIIEDNSGNIGVGEIPGGEKILATLNDAKALVEGQPIGEYKNLLKKIQQTFADRDSGGRGNQTFDLRTTIHVITAYESALLDLLGKHLNVNVASLLGEGQQRSEVEVLGYLFFIGDRKQTSLDYATTPQHNHDWYKVRHEKALTPEAVQRLAEASYDRYGFKDFKLKGGVLQSEQEAEAVTAIARRFPDARVTLDPNGAWFLDEAIALGKHLKGVLAYAEDPCGAEQGYSSREIMAEFKRATGLPTATNMVATDWREMSHSIQLQAVDIPLADPHFWTLEGSVRVSQLCKMYNLTWGSHSNNHFDISLAMFTHVAAAAVGNVTAIDTHWIWQEGTDQLTKAPLEIKDGKIQVPTAPGLGVELDWDRINQAHELYKLKGLGARNDADAMQFLIPNWTFNNKKPCLVR

SEQ ID NO: 6801 - protein, 394 aa, Acinetobacter baumannii
DENIMNLRSLNFGLDETLIALQDSVAAFCAKEIAPIAQQVDQDNKFPAHLWKKFGDMGLLGMTVSEEYGGANMGYLAHIIAMQEISRASAAIGLSYGAHSNLCVNQINRNGNEQQKQKYLPKLISGEYVGALAMSEPNAGSDVVSMKLRAEQKGDHFVLNGSKMWITNGGDADVLVVYAKTDPQAGPKGMTAFLIEKGMKGFSHGNHLDKLGMRGSNTYPLFFDNVEVPAENVLGGVGNGVKVLMSGLDYERAVLSAGPLGIMDACLDVVIPYLHQREQFGQALGEFQLMQGKLADMYSTWLACKALVYAVGAACDKADHDRSLRKDAASAILYAAEKATWMAGEAIQTLGGNGYINEFPAGRLWRDAKLYEIGAGTSEIRRMLIGRELFNETK

SEQ ID NO: 6802 - protein, 271 aa, Acinetobacter baumannii
MLNIVQPNICFIGSSNLSLALIGGLVLKGFQREKINLIEEVKFENQIILKQKQHEVKKADIVVLLLDPKDLKAILAPLKKWLADKTIVSMMAGVNIQQLMSITGSKKIIRVISNPPVLTYTGTHVLIGSDYLEPLDKEVIETIYSATGRTYWANSESQSDAIIALSGSGPAYFFYILDSMVKTGVSMGLDKQFALDLILQAASGAVEMVRKSNVQPSELCGKVTLANGITESALRMFELGNLSDDIRLALKAAYHRSKEINLEINAEITRH

SEQ ID NO: 6803 - protein, 72 aa, Acinetobacter baumannii
NRNIFYFLGEFMTQLINKGGFRERANRSRKYQQSENKQVALPSNKYQPQTKLQDNQNEMIQAKAGTSETSDD

SEQ ID NO: 6804 - protein, 385 aa, Acinetobacter baumannii
NSDIKRKIKCTFVEVTYMKNITEKSLFDVFTQHQAYLYRASSRSVNELYKFFNSETMVMLDRLGDLMKELNETERFALAGGEYTTQHLKNIQLVISNWFNSINTVLPEMFTHSAIALAIYESNYIAKLFGKVIKDLKGERLYQSIKRVPLAGGALVDESLAQIGENALQRIEYAIRDGMNTGMTPQQIIKRITGTKRLKYEDGLLNSTKIDIERIIRTLRSHISNQVYLYNFKNFNFEYVRFVSVLDGRTSKICAAVDGSIWKLNDPAKRVPPLHPNCRSILVPVSKDGRLIGNRSFVMDERKVRDIPKDERTQLMGQIDANISFKEFFNLTDNFFQKEWLGPKRYKLYKVGQFDFDKFFDPKGRLYTLDELRELDERTFKILGL

SEQ ID NO: 6805 - protein, 316 aa, Acinetobacter baumannii
GIDIMASIWVYPGQGVQRSNMLHDLPQTALVKEYLERASDALKEDVLMLDRPAALKSTRAVQLCLLISGVVSSALLRAENLKPDYVAGLSIGAWSAAVVAEVLAYEDAVRLVAYRGELMQNAYPTGYGMTALIGTDRAAVETWVKQIYEITPEVFVANINAHNQIVISGSFEAMTQVAVLAKQQGVVAKKLDVSVPSHCELLSQQAKQLAASMEGVTLKQPKIRYLSGTTARTLSRPEQIGDDLAFNMSRTVDWESTIQAAWERGVRLQIEALPGTVLTTLARRTFKEGTVLSFQGTRLDSIQMAMQKEQANSFSF

SEQ ID NO: 6806 - protein, 197 aa, Acinetobacter baumannii
IGLFFIGVYMFVAGVDEAGRGPLVGSVVAAAVILDPNNPILGLNDSKKLTEKKREKLFIEIQEKALAWSIAEATHAEIDELNILQATFLAMQRAVDGLKTQPQKVIVDGNQIPKGIVIPCEAIVGGDASHAEISAASILAKVTRDRQMAELDQQYPLFGFAKHKGYPTKAHFEAIAAHGVIDQHRRSYAPVKRALGL

SEQ ID NO: 6807 - protein, 167 aa, Acinetobacter baumannii
MKDIYVEFRGKYKVDGESRDSEHKGWLEVNSWSHNIRQPKSATSSSVGGHTAERVEHSDMVFVKDLDATSPKLWEACSAGYTFDEVQIDFYRANGDKRIKYLQIKLKHVLVSSVTPTVNEEGVPTEAFGLKYAAVEWTYNQQDINGTAKGAVTKKWSLSNNTASYAA

SEQ ID NO: 6808 - protein, 210 aa, Acinetobacter baumannii
TGSINVSGLLVFITIAFLTLSSPGPGVLFTVTNSINYGVRTALFGISGLIIGMFIIAVISASGVGLIITSNPTIFTALKFIGAFYLMYLGYKNFIKKSPTQDLLETEHNEKGIKKSKLFYQGLFASLLNPKTIVFFIALFPQFIDIKKEILNQFLVLSLTFCLIGFLIHLVYANFSSIFKEKMLAGNNFSKLNKVSGCIFFLLAVLLITQ

SEQ ID NO: 6809 - protein, 320 aa, Acinetobacter baumannii
AMSMQHVSFQQASPNEQAVILIVDDVPENLGLLHESLDQAGYRVLVTTDGLSAIEIAHRCLPDMILLDGNMPHMDGFESCIQLKASPITQFIPVIFMTGLSETEHIVRGFQVGGVDYVTKPLNIEEVLARVKTHLAHAKLLQQQKQVIDATETAILALDVHGKIVWKTQKASDLLNQYLPELEGFEAGLKAWFSDLEHEKDSKKLTSCFYSTPSQQLQLLLLTPWETEPSVAKNYLIQIKTSTPALEMADILKYCPQLTQREAEVMHWLLLGKTNKDIAEIVELSPRTVNKHLEHVFEKLCVENRTAAVAHINSLVQEFH

SEQ ID NO: 6810 - protein, 91 aa, Acinetobacter baumannii
VVFMKRSIAYRQIFHQCFNATCIFTNATSSLNFVNRLRTINRSILLKYQAIMLLYPVGTLLAKNIYHRSKPNCQSTFLPEIKYLNHLIIIS

SEQ ID NO: 6811 - protein, 366 aa, Acinetobacter baumannii
VVFMGFNCGIVGLPNVGKSTLFNALTKAAIAAENFPFCTIEPNTGIVPVPDPRLDKLAAIVNPQRVLPTTMEFVDIAGLVAGASKGEGLGNQFLANIRETDAIAHVVRCFEDENVIHVNGKIDPLDDIATINTELALADLETVAKAILRLTKVAKGGDKEAVATKAVLEKIQPLLDEGKPARAADLSDDERKLIRGFGLMTLKPTMYIANVAEDGFENNPHLEAVKKLAAEENAIVVPLCNQIEAEISLLEDEDRAEFLEAMGMEEPGLNVVIRAGYKLLGLQTYFTAGVQEVRAWTVKVGATAPQAAGVIHTDFEKGFIRAEVVAYDDFVQYNGENGAKEAGKWRLEGKTYVVQDGDVMHFRFNV

SEQ ID NO: 6812 - protein, 76 aa, Acinetobacter baumannii
KTFIESNLQNNSLLQMLNYDALYLTIKFIFYGLSKIRGPAPSCPNTSLGFLNGHCSNDKQPHPIHQSISSLSLVSF

SEQ ID NO: 6813 - protein, 208 aa, Acinetobacter baumannii
YGFIKNVEMVMAKILVLKSSIMGEGSQTNRLIDVMLEHRKGQGVQDDITIRNLAEMNLPVLDLEIFQALRGAENVTQDIQRIVALSDELIAELKSADLLVIGAPMYNLNVPTQLKNWFDLVARARQTFCYTETYPQGLVEGVKAVVVSNRGGIHVGQETEAVTPYLKAVLGLMGIHDVDFIYAEGLHMQAYRSNALDLASQQVKEFTI

SEQ ID NO: 6814 - protein, 342 aa, Acinetobacter baumannii
GLFISAGVIPMQSERWWQDSSVTAELFQRPKSFEFIQATRLLRHMPANDAALSWSDHFKFETSFNLNFPATEIESLELVDERVHLTNLIVGLTGIQGALPYTYTNKIKQAPRQQRAETKEFLSLFNHKLTSQYVESSITYHLPVRYEIENKNDYLDILHALNGYVRSQHQQQDLDEYFAEFSGLMQGQNNTVHALKTMLSCIFKHEITIKEFVQESFKLAGDQLTTLGGSQPSLLGINTFCGETIQQIDGKIEIQIGPLKRQQYLKFLPHQELSLKLKKIVETWCSPTLSIDLRLILDESEIQPVRLTQGQESGLGQGAFLMSRKPNTHNDETCYSLIGEQI

SEQ ID NO: 6815 - protein, 62 aa, Acinetobacter baumannii
SEFIKLHDHYPVEIFCIDSGAIHKLNSSPSTLYYGIPKINLKKIFGMPECLNVFRNNKTALS

SEQ ID NO: 6816 - protein, 194 aa, Acinetobacter baumannii
TSIMETMMSLINTEVKPFQATAYHNGQFIEVNETNLKGKWSVVFFYPADFTFVCPTELEDLADNYAEFQKLGVEIYGVSTDTHFTHKAWHDTSDAIKKIQYPLIGDPTWTLSKNFDVLIESEGLADRGTFVIDPEGKIQIVEINAGGIGRDASELLRKVKAAQYVHSHPGEVCPAKWKEGEATLAPSIDLVGKI

SEQ ID NO: 6817 - protein, 306 aa, Acinetobacter baumannii
ATIMQHELSAISIFVTVVEAGSFVKAAEQLHLTRSAISKNIARLEEQLGVVLFKRTTRSLSMTDEGALFYEHSRRALSEIQNAAALLDQGKINATGRLKMSVPVLFGQLFAAPLMVKFAQQHADLQLEISFNDRNVDLIEEGFDLCIRIGALPDTTQLVAKPIGEHRMLLCASPDYLNKAGPVEHIEDLEHHATIADPHFGQMQKWQLKKENDEPLFIKPKAKLLLNDLQAIKNAALAGAGIAWLPDWLIQNELQDGKLVQVLDTMSSTAFPIHLVWPTLPFMPLKTRLAIDYLAQHLPPELNKQA

SEQ ID NO: 6818 - protein, 141 aa, Acinetobacter baumannii
GIVMIIYGVGLLALCTLVGVIAGDLLGVLLGVKSNVGGVGIAMILLICIRLWMEKRGMMTVETEKGVSFWGTMYIPVVVAMAAQQNVVAALSSGHMALFAAVVSVAVCTLTIAGLSRFNKASPLPKEEDTALNRIGGKVHG

SEQ ID NO: 6819 - protein, 127 aa, Acinetobacter baumannii
GVVMNHPSELKYARTHEWVKIEGDLVITGITDHAQDELGDLVYVETPEVGSQVTAGEQAGVVESVKTASDIHAPVSGTVVEVNTDLEDDPDFVNEDPYGKGWIYKIKPDNIADVEKLLTNAEYEAGL

SEQ ID NO: 6820 - protein, 267 aa, Acinetobacter baumannii
GVVMSVLEAKHIHLTFPKQQKPVLQDINLTIEEGSLTVILGESGCGKTTLLNILAGFQKPSSGDVLVNHEVVTGPDVTRAVVFQDHALLPWLNVADNVGFALQLKGLKRAEIEAQVNAILKIVGLSHVEKANIWELSGGMKQRVGIARALISHAPFILLDEPFAALDAFTRENMQQLVLDLWIQQNKSFFLITHDIEEALLLSNQLVLMTAHPGKIVETLHLDFAQRYRQGESIRSIKSDSQFIQLREQLFESLRAQKQSGKEALPT

SEQ ID NO: 6821 - protein, 203 aa, Acinetobacter baumannii
AMVMKLKLEAHDLLWGMTVDCLADDAPHWVKEVLLRGDPVVVRREITPEDQVAVGIRGQFRYQRYAAQMPRSVISRQLKPEALAEVNPSHFKHLAERLQSISSIMKNFSGCWGYTGSFGFELATGIKTVNQQSDIDLLIRAEQPFAKKQAVELLENFQQAGLNVDIQLQLPQGGLALKEWAGNSGKVLLKRLDGAVLVENPWN

SEQ ID NO: 6822 - protein, 170 aa, Acinetobacter baumannii
INTIRGGIMLQQCCQLLEDRLLKVAFIESASSGYLTSQFSIHKNSGADILLGGLVSYDPSIKISVLKVDPKLIETYTAESPQVTEEMCRLGQTLFQQADIVVSCTGLLKPGGSETTEKPVGTFFICISYLGRIYHYHYFLSGHAEQKLKTLTQKVADSIIALVSSNQHKS

SEQ ID NO: 6823 - protein, 389 aa, Acinetobacter baumannii
NMTISETWLLPDGVADVLPEQAQVIEKLRREAIDFLAVRGYQLVYTPFIEYIESLSSLSESNQDLDLVTFKVIDQLSGRLLGIRADMTPQVARIDAHVRPVEGVARYCYAGTVLHTKPQNFNATRAPLQLGAELYGHDSIEADVEMVDVMLGLIENAYTLQGAHLDLGHVGLFRSLVKYAGLSKNEEHELSDLYQRKALPELAEFTQNLNMGSDFYVLGRYASDLDALQAHLSADILKDAEFDAALNALKTTLEQIKNRWPALNVGIDVVELRSYHYHTGLMYAVYAPNRAAPLAQGGRYDGIGEHFGRARPATGFSCDLYALGANQFAEIETVVAPKGTEADLLKAIANARSEGLRVVQLLGNDDLSSIPYATHQVVLQNGQWNIEKI

SEQ ID NO: 6824 - protein, 338 aa, Acinetobacter baumannii
INAIIMDMTMTLRNDWTREEIQALYEQPFLDLVFKAQQVHREHFTANTIQVSTLLSIKTGKCPEDCKYCSQSAHYDSKLEAEKRIAVEKVISEAKAAKDSGSSRFCMGAAWRNPHERDMPYVLEMVREVKALGMETCMTLGMLNQSQAERLKDAGLDYYNHNLDTSREYYSHIISTRTFDDRLNTLDYVRQAGMKVCSGGIVGLGESREDRIGLLHELATLPIHPESVPINMLVPIEGTPLADVEKLDVIEWIRTIAVARIIMPHSYIRLSAGRESLSDSDQALAFMAGANSLFSGDKLLTTPNAGEGKDQALFNKLGLTAEKPKPTISELSVDAMSA

SEQ ID NO: 6825 - protein, 371 aa, Acinetobacter baumannii
EFYMGIRITGTGLFHPTEIISNEELADSLNAYVEQYNQENAEKIAAGELEELRGSSAEFIEKASGIKRRYVIEKSGILDPTRLRPRLSERSNDELSIQAEWGVIAAKQAMENAGVTAEDIDVVILACSNMQRAYPAVAIEIQSALGIQGYAYDMNVACSAATFGLKQAADAIRSGARRVLLVNVEITSGHLDYRNRDCHFIFGDVATASIIEETTTKTGFEILDIHLFTQFSNNIRNNFGFLNRSEDAVVDDKLFRQDGRKVFKDVCPLVAKIINAQLEKMQLTANDIKRFWLHQANANMNELILKYVAGKDADLSRAPIILDEFANTSSAGVIIALHRTGHEVDDGEYGVISSFGAGYSVGSIVVQKHVA

SEQ ID NO: 6826 - protein, 1160 aa, Acinetobacter baumannii
CSHMPNMSVMPDSSRPQQAPQRVIKTRREYNIWVADESIEDYALRYAPTSVRKWSPWTVTNTAISTVSFLAMEAIGATMLWQYGFSNALWAAIVVCTIIFLTSWPISYYAAKYNVDVDLLTRGAGFGYIGSTITSLIYASFTFILLAFEAAIMAMALELALGIPQVIGYLISALVILPLVVKGIGFINKVQAITQPIWLLLLLLPWFFVLWKQPQILSSSLHFVGAVSNSTDFNLYYFGAACTLIFSFVIQIGEQADYLRFLPQKEKNRTAWRFAVFLGGPSWIIFGFLKVLMGMLLMVLAFQLFIPISELDNPTYLYWVAYQQFIPNPQLALILTLALVCLAQIKINMTNAYAGSLAWSNFFARLTHSHPGRIVWLLFNVFIAIVLMEMGISHAVERILGLYSNIALAWIGAVVADLIICKPLGLSPKGIEFRRAYLYDINPVGVGALLIASVLSMLSYLGLFGLMAKGLASFIALGSAVLCVPIIAYLTKGKYYIARQPEKIQATSVANCVVCERDYELADMAGCPAYNGTICSLCCSLEARCHDLCKPDARWSVQLKKAIWHYLPERWASRLNSRVSLYLLLTLGLSIVLAVSLSLVYIQEKTYLETIDAAAVPQLFTLFVKIYTILFLLMSVAAWWLVLNDESRRNAEIETHQQTALLIDEIAAHEVTSKDLQDARISAERANDAKSRYVIGISHELRTPLNSILGYSQLLQKQEQLSEQGKMALGVISRSGQHLTSLIDGLLDLARIETGKISLNVVDVHFPNFIEQIIQMFQPQFEQKNLQFVYEIGENLPHYVRTDKKRLEQVLINLLGNALKFTTSGTITLKVEYRFQTAYFEIRDTGCGIAEADLERIFNPFERGSNVVQGGFTGTGLGLPIVKLLVDLLGGQLSVTSQLNQGSQFKIKFYLPSKEVVHPISNVYSNQITGYQGERKRILVVDNEAVDRGLVANFLKPLGFMIEEAESGIDCLRRVPIFQPNLILMDLNMPLMGGWETARLLRQNNITNVPILIISANAGEREVNPQDAVLSEDFMLKPIDLNLLLSKIGDKLGLVWIDSKSETLLENNEVQTLDLNIYKQEQAAVHTPVKQLENNDLLDLPQSLQQLNDLIGQGYIRGIQQTLMQCRQNFPEHDELWEQLEQAIRKFDLKHAQRLIQDKQ

SEQ ID NO: 6827 - protein, 172 aa, Acinetobacter baumannii
FYNILKTIVGRIKMFNKCCELLAKEKIKIAFFESASAGYLAYRFSLSPYSGDILIGSLVSYDLRVKENTLHISEELVEKYTAESMQVTVEMINKGKELLHADLYVACTGLLKKGGSETPEKPVGTFFYSIYYKNNFYNFRRVLRGPAFLKLRKLIYYVTQDIKLIILEDKRR

SEQ ID NO: 6828 - protein, 283 aa, Acinetobacter baumannii
GANMSVGSLNWTIFCAESNEYGVDKAAWAESVCKVIGSSSYNAYAEAPTWLQMLGSGVFTMVWTAIVAFLIAFLLGSLLGVIRTLPNKPLAFIGNCYVEIFRNIPLIVQLFFWAFVFPEFLPDSLSAGSGDVVAGGWWKNILNQQPAIIGVFALGLYTAARVSEHVRAGINTVSRGQKFAASAMGFTTAQSYRYVILPVAYRTVWPTITSEAMNVFKNSAVLYALSVLNFFAYTKTMREETSQDIIILILSTPVYLIITYTIKFIMAWIEKRMAVPGLGSGGK

SEQ ID NO: 6829 - protein, 331 aa, Acinetobacter baumannii
IADMNPKYLILITSVFCSMSSYAQSFELNSDITDELNTALKNNKNVTIPPGDYKVDALKSIKPQNGSVITMSENTRLNVIPNKSGAYKVFDISNVKNVTITGGELIGDKYSHLNKYGEWGMGIDIRDSQNIRISNMKISKMWGDAIYLGNNNNFSNSDIVLSNIIMNDNRRQGVSVITAKNLNANNLTIKNTSGTGPASGIAIEPNNNKSHLENLTFKNITTENNKGAGIQITLKFYKNPKNPVSISVINHKDNRSTFGSIVNGIDSTQAGQINFNKLAYKNNSNSNTCFSNWSNTKFNIKFTEATLDGSKGVSEWCHDVSKNKRILVQKN

SEQ ID NO: 6830 - protein, 715 aa, Acinetobacter baumannii
VMDMNDNTKSTNKTSEMAGADAANKANTTQKTEQLDTVRDDATNEALTTNQGVKIADNQNSLRAGIRGSTLLEDFILREKITHFDHERIPERIVHARGVGAHGYFQAYEGNERLTKAGFLTDPTIQTPIFVRFSTVQGPRGSADTVRDIRGFAIKFYTQEGNFDLVGNNAPVFFVQDGIKFPDFVHAVKPEPDTEIPTGATAHDTFWDFVSLVPESAHAVIWAMSDRAIPRNLRSIQGFGVHTFRLINAEGKSHFVKFHWTPKQGLSALVWDEAQKLAGKDPDFHRRDLYEAIEQGFYPEWELGVQIVEEEDEMNFDFDLLDPTKIIPEELVPVTPIGRFVLNRNVDNFFAETEQVAFCPGHVVPGIDFTDDPLLQARLFSYTDTQLSRLGGPNFHQIPINKPVCPFHNNQRDGIHQHTIHKGQAAYQPNSIDGNWPVETPPAASNGGFESYPEKISGHKLRQRSETFSDYFSQPRLYYKSLAPHEQKHVVDAYTFELSKVQRKHIRERQVQQILANIDLDLARQVGANLGIEVPDLTLNYKKTAVEKSAKLSFLAFPPEDIQGRKVAVLIHNMVKSDALEAIKNWAIKEGVILHLLAPSLAPVKDHKDNVIVADGMQMSEPSIAYDAVIIPDGDNLNTVMQDGVARHYLLEAYKHLKPIVFLGNKSDLLEPLGLVADEGTLIEDEFQHVAEKFKNLIKAHRVWSREQIAAHVPA

SEQ ID NO: 6831 - protein, 345 aa, Acinetobacter baumannii
FEDILSDTVKYAWAFERSVHSVRLMADFALESGISYQTILQGTGLSQQQLLDPNMVVTGHQELQLIHNLVEQLGDRPTLGLEVGTRYHFTTFGPLGMALMSSASIREALDLALTYFTLTFAFTRFDASDTPQGIRIEIDEQDIPSSVRQFIIERDAAALITVQRDLVQDNFCQYLAFSFQPKGDAEPYRNLFGVMPEFGAAKSFVILDPQKVDQKLLMANELVLHTAEEQCRQILEKRQSQNKFTTLVQQQLMSMRGEMPSMDIVADRLHLNIRTLRRHLASEGMTFIQIREEVRQVLAEQYLALPKASVEQIAEWLGYAEPASFIHAYKRWHGKTPHAMRLNSQ

SEQ ID NO: 6832 - protein, 76 aa, Acinetobacter baumannii
VVFLLFIGQFKIRIKKRFIFPLQYHEIWSVIMQKPVKRGDAWRIIVRYLGKRYTATRDTASECEQWAAKKIIRITI

SEQ ID NO: 6833 - protein, 151 aa, Acinetobacter baumannii
MDRIDKKILAELQLNGRLSITELAEKVGLSISPCHRRVKALEESGAIKGYRAELDPNLVGFEFSAIVFITLKEGDKQAVEKFENAVIEIPQIIQAQRLFGEPDYLLHVVAKDLPAFQRLYDEKLSAIPSVQRLISTIVMKDVVPERLFPIG

SEQ ID NO: 6834 - protein, 211 aa, Acinetobacter baumannii
GKRMLKILGRDNSINVRKVLWLCDELNLTYEREDWGIGFRSAQSPEFLQLNPNGQIPVILDGDLVLWQSNSIIRYLANAYDKDHILYPTQAKQRAIIDQWIDWQAIELNNSWTYAFMSLIRHSALHQDPNLLQQGIDQWNKQMQILDQQLAKTQAYVAGTEFTLADIPIGLSVQRWKATPFDHPALKHVDQYFERLNQRKGFLKWGNNGQP

SEQ ID NO: 6835 - protein, 367 aa, Acinetobacter baumannii
TSSMMIIRYIEPRDVNDLYLLAQKAGFGLTSLQPNMEKLAARIERACKTVAGELPKADQVYLFVLEDTELNKVIGVCGIEVALGLKEPWYNFHVGTQVHASEPLSVYNALPTLYLSNDHTNCSELCTLFLDPDYRLNKNGKFLSKVRFLFLSAFRQYFEETIVAEMRGYSDANGQSPFWNAVGHKFFNIEFTKADYLSGVGQKAFIAELMPRHPLYVDMLPDDAKAAIGIVHPNTRPAYNLLLEEGLRYKGYVDIFDGGATLQADIENLRAIKESQILTVQVVESIPLSSGDEPYIVANDNYENYRAILVYSQPHQNMLQLTKEQANQLNVENGSLVRVLSVQVKQISSPEVVNKLKATEYLRMAVN

SEQ ID NO: 6836 - protein, 200 aa, Acinetobacter baumannii
ASLMDDINIRIAHRIRELRLARGYTLDVLAARCQVSRSAISLIERGETSPTAVVLEKLANGLEVPLTQIFTNEVGNSSSQPLIRRNEQAEWRDPETGYIRRTVSPPNLKLPFQMVEIEFPPHSRITYETNESSRVVQQQLWVVEGKIEIQLGETSYALGQGDCLAMQLDQPVIYSNHSAQVARYILVVSNQLVPALKESL

SEQ ID NO: 6837 - protein, 70 aa, Acinetobacter baumannii
CSLIYFKMSFCMTRSFIEGIQINLNDPSDFSRKLGCRDVGEYVLVAKSFKTSAKIFSFFKLNSLKDRSSG

SEQ ID NO: 6838 - protein, 182 aa, Acinetobacter baumannii
GVLIVQVCFKKLLEEVGECNEIIYGEGFLINQVNSVNDDLFKSYLSCIPENDFNIDLGGNINDFLGKDSLDNIQYMFEDIFDGESATVFLTQHDVNIVYINHNSGEIGACISGDELHIIAKNLFYFFSQINVIQNLIIDLYDSNPRGENGGYKTGFLEELKKTLIKENVVLDADYFMEFFYG

SEQ ID NO: 6839 - protein, 262 aa, Acinetobacter baumannii
PMLMNKKFVLSLCAAGAVTISGCATMADMAGADTATLNAQSAQSFNKMVQEARGKGALDTSSSTYNRINAVFNRLKPYANQMNQTGQPFSWQLAVLKSDTINAYVAPGGKVVFYTGIVNKLNLTDAEIAAVMGHEMTHALEEHAKSKIGAQALTDLALNIGLSQINGGNVSQLGAAAAQLGTQVGVGLPYSRSLESRADQGGLMLMARAGYNPNAAITLWEKMNKLEGSGSSFLSTHPSNAQRINDMRKNLPAALAIYNGRK

SEQ ID NO: 6840 - protein, 522 aa, Acinetobacter baumannii
IKLINVYSAYRKLRFFRSLFLRILEQPMFNSSSNSNKNVRIAIIGTGFGGLGLAIRLKQAGFEQFTLFEKAADVGGVWRDNTYPGAACDVPSHLYSFSFEQELGWKNRYGTSQEIYQYLRHCADKYDLRPHIKFNTEIASAEFDALQGVWHIQSTTGEQFEAEFLVGAVGQLNRPAYPKLKGIENFKGKAFHSARWDHDYDLTGKRVAVIGTGASAIQFVPEIAKQVAHLDVYQRSAPYVIPKPDRVYQPLEKKAFRKLPILQSLDRALQYGHHEIRLLAFTTSLNEMPLVEYIFQRHIRKVVKDGKLRHRLMPDYPIGCKRILISNHWYETLTQPHVDVIDTGIQEITEHGILDTEGKLREVDAIIYGTGFTATEFMAPMQITGLDGRTLKDTWKDGAEAYLGLTVNGFPNFFMLYGPNTNLGHNSIVYMIESQVNYILDALRTTLKNNLLFTNIRAEIQHEFNQNIQEKMKKTVWAQGCTSWYQTADGKNTNNWPGFTLEYRQRTRRFDIENYTQVSAIS

SEQ ID NO: 6841 - protein, 437 aa, Acinetobacter baumannii
NYIMRREAMDSLTMDNVEQLTLAELRELQTKRLKQTLTFVYENSPVYKKKFDDAGVHPDDFVTLDDLAKFPFTTKQDLRDNYPFGMFAVPQEQIVRLHASSGTTGKPTVVGYTQKDINTWSDIVARCLRMAGLTAKDMVQVAYGYGLFTGGLGAHYGAERLGATVIPMSGGQTEKQVQLIQDFKPTAIMVTPSYCVSIIEKLEQQFGTARNTSLKVGIFGAEPWTNELRREIEERLNIKALDIYGLSEVMGPGVAMQCLGEGEGLTIWEDHFYPEIINPETGEVCKDGELGELVFTTITKEGLPIIRYRTRDLTRLLPGENLAMRKMDKIVGRSDDMLIIRGVNVFPTQIEEQILQVPHLVPNYEILVTKKGHMDTLHIRTEMCHNCTIQANQLAQELMKRIKTMIGISVTVEVVTEATLPRSEGKAKRVIDMRQIA

SEQ ID NO: 6842 - protein, 122 aa, Acinetobacter baumannii
YLVILMSVGSILHAEEYESTVCEKLNIAAYQIMLERQSGIKSLDLLEKLLIPLAQDKENVITNSRINNFFGHVSGLAYETPLYTKEDEKQKAATDFGLRIERICTKDKTALFAPPLFQTFEE

SEQ ID NO: 6843 - protein, 348 aa, Acinetobacter baumannii
KFQIFCRIHAMSNHNVALQFEDGVTRFINVAQGETLSDAAYRQKINIPLDCRDGACGTCRAFCESGSYDMPEESYIEDALTPEEAEQGYILACQCRPTSDAVFQIQASSDVCKTEIHSFQGTLARVENLSDSTITFDIQLDEGQPDIHFLAGQYVNVSIPETGETRSYSFSSKPGNRLTGFVVRNVPNGKMSEFLSKNAKTGDKMTFTGPFGSFYLRNVVRPVLMLAGGTGIAPFMSMLQVLEEKGSEQPIRLVFGVTNDFDLVALEKLNELQAKFPWFEYRTVVASPESNHERKGYVTGHIESEWLNGGDVDVYLCGPVPMVEAVRSWLETENIKPANFLFEKFSAN

SEQ ID NO: 6844 - protein, 167 aa, Acinetobacter baumannii
AMQMIRHCIDQCWDVLQTVSDPEIPVLSVVDLGMIRGVEINDQQEIIVRLTPTYSGCPATDMLKAQIVEAFTAEALTPVKVMVDLSEAWTTDWMSDAGKKKLQVYGIAPPEGLAHQCGTHVHLNDGVECPRCKSRHTRLLTEFSSTACKALYKCQDCLEPFDYFKCI

SEQ ID NO: 6845 - protein, 391 aa, Acinetobacter baumannii
ISQIGSLMNHVQFDLIVVGAGILGLSAAIQAQEQGLKVCIFEKNAKPVGATHRNFGMVGTSTLTHPEQQWRKYALETRSFYQRIQAETDISFEQRQGVYLANTALEWQVLNEFAERANKYQIPVHLRSHDELVTQFSYLNPAQQFQGGLVFEEDYSVEPHVVGQRLLAYAQSQGVEIYTNACVVQTQYQQESCQVRLASGEAYRANKVLICHGEIIDVLYPDLLQSLNLKRCGLQMALTQQFHQKLNASFYSGLSISRYPAFEICPSHAELVKASQQGFIKEFGIHILIKQNEFGELIVGDSHEYHSINEAPQFEQREEINEFIQTYCHEKLGLTLPPIQKRWNGYYLTHEHELACITEAEKNIFLVSAIAGKGMTTGAGFMKEVLEQNIY

SEQ ID NO: 6846 - protein, 108 aa, Acinetobacter baumannii
VFKMNKMHVTLAVVVGLIIGGVVGAIGYSKTAARYDAMTTACVMVNQAVEHEILKPEQVKELGELTGQTLKKDYASVASKFKFSENQLGNASEGSNCSQFIVGVNAAQ

SEQ ID NO: 6847 - protein, 252 aa, Acinetobacter baumannii
RLKIPHLNFNIAKVMSIDQLETQIAELDNLPEHREIVTFMRRSAPLNTSQRTALEQHRDLILEYPVGDLRQHFEHPERPLTVEIGFGMGRSLVLMAKANPERNYVGIEVHVPGIAQCVYEAGMAELKNLRVLDADAIQVLREMPDNSINCVQLYFPDPWQKKRHFKRRFVIHERMQLVEQKLELGGTFHAATDWEPYAEWMLDVLDNRPNLENLAGKGNSYPRPEWRPVTKFERRGIESGHKINDFIFKKIK

SEQ ID NO: 6848 - protein, 120 aa, Acinetobacter baumannii
RLKMAKTQNKCEVTVNGKTYPCHISMAMDLVGGKWKCVILYYLKDGPKRFNEINQLMPTITEMTLSLQLKQLEQSGLISRTVYGEKAPIKVVYEMTELGQSFKPVLESLSVWAHTMINQS

SEQ ID NO: 6849 - protein, 157 aa, Acinetobacter baumannii
GSKMALNLSKIKAEASEDKKLEEITAENHKKITDGVAKHRKDLKEWFISLFPGENIESDYVETSVLFDGDWKVTLALQLMTKAPEGNLVQVNTKANFMFKKTKNERIIASAAFIDETDYLNLEPESKDYKYSYTVQDQTKYFTFAELEQFVQYVIDK

SEQ ID NO: 6850 - protein, 146 aa, Acinetobacter baumannii
FRKMSTESASGTPSQPSLFVLVKQILILAGFWWIGYLLHQKLGVPVSAGILGMFLLLLCLFFKIIKMDQVAMGATVVLGELLLFFVPVVVAVVQYKTLFMTEGWQIVLSIGVGTILVMLSTSLTIHYYNRLKAYLQARKRLQHKHI

SEQ ID NO: 6851 - protein, 139 aa, Acinetobacter baumannii
KGKIMAYSASCLCNGIQLRINAELESIMVCHCKQCQKAQGAAFAAITQVQKSDLEMVQGENLLQAYFASPNKKRVFCKTCGSPVWSERLDKPDVVRLRVGLINEEISTPVISHAFVNSQVKWYPICDTARQYPNGVENP

SEQ ID NO: 6852 - protein, 258 aa, Acinetobacter baumannii
RCVFQVSPSVQRTPTLFQAGASPKGMQFATRHAECVFIGGDKPEKIREQVKKIRTLAEQQGRSANDIKVFVGITVVVAETHDLAVQKLNEYRQYASPEAGLAHYASSTGIDLSKFADDEAIPYQKSNSIVSITEKFKEQQITKNDLKAQHVLGGRYPLIVGSGEEVAEYLIHLLDETDIDGFNLTRTVAPESHHDFIRLVIPELQQRGRYKTAYKTGSLRNKIFNRGDHLPEQHPVQAFRCSPYNNSKNLTKIEEITA

SEQ ID NO: 6853 - protein, 271 aa, Acinetobacter baumannii
GKKIMNAYYQLLNRTIGPQGEVIAHYCSTVHAQGAWNPHEQHMAPASGVIAVELEQFSPRQDMRIGRISFDIFGLIAFGEFTIKTHVIRAGKTIELIEAELQAQGKTCIVARAWRMCTQDSSEIAGLEDQPIHHPDTFTEWSGMKRWPGGFIQTLVTKTNDQHRAGKGIVWLNNDKEMVEGQPTTDFAHLIGMVDAANGIVPRQEGEFTWGFPNLDLQIHMHRYPQGKWLGLETVQQYGSDGIGLTSAVLHDVYGPFGRSEQILTLRKMTK

SEQ ID NO: 6854 - protein, 404 aa, Acinetobacter baumannii
AIEIKKEAQTSVWALASLLPKKRFNMPHDTEFELFRDSYRRFLKEQVAPYYEQWEHDGLIPRELWLRLGENGFLCVDVPEEYGGYGAPVHYSLMLVQETAQAGFASLAVAIGGQNELVSPYLQNIGTEEQKRYWLPKMVTGEVVTAIAMTEANAGSDLQAIRTQAILENDHYRINGSKTFISNGLHADLIVLVAKTDPQAKAKGISIFLVDAALDGVKKGRSLQKIGLHAQDTAELFFDDVCVPATQRLGEEGQGFAYLMQELPRERLSISMMALGSILGAIELTKDYVLERKAFGQPLSQMQNTRFVLANAQIKAKATQAFVDRCAALYQQHQLSVTQVAALKCFITDVQCEVIDQLLQLFGGYGYMQEYPISRFFVDARVQKIYGGTNEIMKEIVARELLGK

SEQ ID NO: 6855 - protein, 197 aa, Acinetobacter baumannii
WKEMAQEKPTSIRVLQSNKKKSRSPVIYIIIGIIAGVFVSISLFLFLSQPYSSDPTSVESKSNQDQELDQVLMTNSSADDQAVSDQQEQTDPMSHDGFEQPKENELSNIFKPAPHKEAAPNPQRVSPFDAQLTGEQVVPKPVQPKLQVVQQKPATQTKVVQAKPAEVNKAPVEQEADVEPPKASVDIKITRSPFAVN

SEQ ID NO: 6856 - protein, 448 aa, Acinetobacter baumannii
LEEIMAETKKPDAIGDAGAYTNFVSNIGTSRDKASHGHFVQKEIPDDQLEAVYQHWLAKRIVNRPASDMLRAGWFYEGIQDRDLIKLEEACKAFQLNQILLSSLILSRLYGVVYVLLGTVDGGNLEQPFDLKKLGVGRLEFFTVLKKKYIKPDTTTYLSPKVCGGLLKQPEFYKLQMDGKAPQRIHHSRLIKFCHADVVNEEPQSILQEVYEDLLDHAAVKKGSASLVHESKIDVIKTPGLVDKIKEDMKAVAERFLSVGLLKGLNGMIVLDAEEDYDSKTYNFAGLPDMMREFSIQTAGAADIPYTILFGQSPAGMNATGEHDTRNYYDSIATKQTWMLKPFMMQILDVICQTTFGRVFPNLDIVFNPLWQLDAKVRSEVEKANSERDAKYLEMGIITEPQIARQLLIDGVYSVIDEAHIKELEIMVKLNVGDHSDAETSPPAGEEE

SEQ ID NO: 6857 - protein, 287 aa, Acinetobacter baumannii
FVRIADRNNQNNRNERMPSHDAFLEHPNSHEKIRQDDYIAGLAKGLALLEAFGTDRQRLNVTQVAERTGISRTAARRYLKTLKYLGYLETDEHYFWLTHRVLRFSSSYLSSAHLPKVAQSFLNLLCAQTSLTFSIVVLDDNEVVPIARSYLPQQDNLRVSPYGMHLGNRLPAHATSTGKVLLAALPEEAQHTWVKNYGLKRLTPFTIVDESKFFEVLKGISLSDYCLSKEEHELGVIAIAVPVFNAQGQAVAALNCMSQTNRVQEDYLVQQILPLLRNTANELRNVI

SEQ ID NO: 6858 - protein, 409 aa, Acinetobacter baumannii
RKRMKILPSSEYDQILKYSVYWLVISIVIGVVAGLASTLIFVAFDISNKVRSLHHWLIYFLPFVGFGIGYLIKKYGSPIERGTHLLIDEIHQPKSFIPKRMSPIIFITSILTQLFGGSAGREAPAVQLSGALIDHLSHILKISEDNRKICLIASIGAGFAGVFGLPLAGAIYGLENAALGNLRYSAIFPCFVSALIASAIPELFEIVHPHVFYVISEFPAIHFGTLMSLIAAGLIFGLVARFFIAAIHFASDVFYKYVRYLPLRTMAGGIVIMLLTLFTAHQQYNGLGTDKIISSFYVPIEFYDFFNKTIFTAITLGSGFKGGEITPLFYVGATLGNALGAVLNLPISLLAGLGLVSLFSGASKAPLTSIILAVELFGMNVATYAIITCLLAALFSGNCGLYRRKKLMD

SEQ ID NO: 6859 - protein, 235 aa, Acinetobacter baumannii
INRIAFRRRVFMLIHADFSQAVIVKPEDYHWVKSPRGEVDRVMLDRIGDEIARATSLVKYAPHTTFPEHRHHHGEEILVLSGVFTENQNLHYSAGWYLRSPHQSVHQPSSEEGTLIFVKLMQIPMSETQALRINTNDPAQWQKIDTRLICTLIDASYEHTYLEKLKPQQLFIEEAEGGIEILITQGQLVDKEMVFDAGTWIRLPPKTLAYFQAGLSGASLYVKTGHLASAIAEYN

SEQ ID NO: 6860 - protein, 631 aa, Acinetobacter baumannii
FTRMEFRMTEINLILINGKITTLDPQNPEVQAIAIADGKVVRTGTNDEVMKLATPTSKVVDLNGRRVIPGLNDSHLHIIRGGLNYNMELRWEGVPSVADALRLLKEQADNTPAPQWVRVVGGWTEFQFAEKRLPTLEEINKAAPDTPVFVLHLYASAMLNRAALDVLGFNKDTPDQPGGKIVRDEKGEPTGLLLATPSAMILYSTLGKAPKLPVEDQVNSTRHFMRELNRLGITSAIDAGGGGQNYPEDYDVIKQLHDQNQMTVRIAYNLFAQKAGQELDDYRRWTEMTFPGDGDELFRMNGAGENLTWSAGDFEDFYEPRPDLPEKMEGELEAIVEHLAEKKWPFRIHATYDESISRLLNVFERVNSKQPFATRFIIDHAETVSERNIERIGALGGGIAIQHRMAYQGEIFVKRYGAEAAQATPPVKKMLELGVPVGAGTDATRVASYNPWVCLYWLSTGKTVGGLPLYDEKNLLDRQTALKLWTKGSAWFSGEKDIKGSLTAGELADLVVLSDDYFKVEAEDIQWIESVLTVLGGKVVYAGAEFKQDDPPLPPASPTWSPVKRFGGQWRLSENRNAPSNQSLQSQSALCACASSCGMHGHSHAWMLDVPVNDKDKKSFWGALGCSCFAF

SEQ ID NO: 6861 - protein, 244 aa, Acinetobacter baumannii
EYGILGVIGMTQHLDVEELQNLLKTVVDETTSITETLASKASKILSKHAAEKNADIKLSTSERAALQKEIKKALSQSHYSQGTGFASYSPATQDEQDYWTLEWWYKKEDQLQQAKLENYQNAQRFLDFRSFEWFHKPAQNKSPCIHGPYVDYICNGAYTITIAHPVMIHDHFIGVIATDILVSALEKLLMPKLKNIKQKAVIMNDSSRVITSNDISIRTGTLFKDKTDQQFFSQPCQSFQLVVI

SEQ ID NO: 6862 - protein, 115 aa, Acinetobacter baumannii
ACGISACSGGSCMNEFVKIVEVGPRDGLQNEKQALTVEQRLNFINDLISAGLKSIEVGSCVSAKWVPQMAQSDELFMLLPQTTDVQFSLLTPNIKGFETAQAGRMQRGCGFYRSF

SEQ ID NO: 6863 - protein, 202 aa, Acinetobacter baumannii
FSTFLDKLILEFCNLIVSHISMKKFLGNSIFKAVGWTYDADPTILEKKQVIIGFEHTSNLDAILSIALFQILDLKIHTLIKKELFKGPMKPILEKLGGIPVDRKASKDIVSQMVEKFQSSDTFNLVIAPEATRAKDGSERKPIRTGFWHIAKAANVPIVLMYANARTKKGGILGKIYPTDLQKDLETIKELYAQYDIDVKIN

SEQ ID NO: 6864 - protein, 122 aa, Acinetobacter baumannii
NNLMRSKLNMNLEIILVGIIVGIANFASRFGPFFVIQKLQGNQQRRGSIWLKIALGSIGISAISAMLVVATLPPLLETPNKSLAMLIGFLVLAGLYFKFKKIVPATLTAAIVYGLIYTYLPL

SEQ ID NO: 6865 - protein, 398 aa, Acinetobacter baumannii
TRLMYIEMNAKEMSTIMNMQPQLDMDLENKYLLLTPGPLSTSATVRRAMQKDWCTWDQEYNSLVQDIRNRLVKLATSEPEKYTAVLMQGSGSFAVESVLGSAIPRDGKILIINNGAYGARMVQMACCLNIEVVELNYLETQTPDLQEIERVLEDKTISHVACVHCETTTGILNPIQEIGRSVKAAGKIWIVDAMSSFGGVPMDIAELEIDFLISSANKCIQGVPGFGFILAKRDCLEACKGLARSVSLDLYDQWNTMEQHNGKWRFTSPTHVVRAFYQALLELEAEGGVAARYQRYLQNQQTLSKGMQQLGFELVLGKECPQSPIITTFLYPTAETFSFQSFYETLKKSGYVIYPGKVTDLNCFRIGNIGEVYIHDIEGLLAAIASYCESHLNQAVTV

SEQ ID NO: 6866 - protein, 173 aa, Acinetobacter baumannii
LMTLLFKIKLIHKICNSVKNELFFTNLIIDNYIMDNIDQIILGLLKDNARMSVTELAEKVHVSRATIKKRMEYLESSGIITGYTVRFKPNAERNVIRAWMSIMVEGTKAQSVIKELRLESAVECLHKTNGKWDILVELRSDTLENFDKVLERIRNISGIYNSETSILLASHKT

SEQ ID NO: 6867 - protein, 222 aa, Acinetobacter baumannii
IVLIFTARFLAMYIPDDFAENRLDVLHSLIAEHPFGVLFTHGSNGLDANHLPFELQANEGKFGILHAHVSRNNSVWQDIKNGDEVLVVFQAGDAYISPNWYPSKHEQHRQVPTWNYRVVHAYGKVTIRDDERYVRGVVARLTRTHEASQPEPWKMSDAPKDYLEPMLKAIVGIEIEITKLQGKSKLGQNKERRDILGAADGLSKSGHQTIANAMYSVAELNK

SEQ ID NO: 6868 - protein, 247 aa, Acinetobacter baumannii
MPMIDIQHISKWYGDFQVLTDCTTSIEKGDVVVVCGPSGSGKSTLIKTVNALEPFQQGDIIVDGVSLKDPKTDLAKFRSRVGMVFQHFELFPHMTVLENLTIAQVKVLKRSVAEAREKGLKYLERVGLLAHKDKFPGQLSGGQQQRVAIARGLSMDPICMLFDEPTSALDPEMVGEVLEVMVQLAHEGMTMMCVTHEMGFAKRVSNRLIFMDEGKILEDCPTHEFFDNLEARHERAKIFLEKIQAMH

SEQ ID NO: 6869 - protein, 318 aa, Acinetobacter baumannii
VMMIFLIFFCFACLAIGLAFLMSYELRNKGRTFVLSLLPQGRRQLNQVRQFAQTMNQAAAPEKLQSHWHLQQWWIVIAGFFLFASILIFAFTRPISSTRIEAEYLKKTDPQIYALLNGEILSPPPEVDESLIEAAIVEATQLEQQYASQESGVINSSPIDNTSFDGRAILDTSLVNRKWDKMNPRYKQRLLMVFKIMKEQYGYELVLLEGYRSPARQNMLAGNPNTTRAKGYQSYHQFGLAADVAFKRNGKVVISERDPWAMQGYRLYGQVAESVGLTWGGRWKSIQDYGHTEYRMPGLKKTQEMAEKLIAESLNDIS

SEQ ID NO: 6870 - protein, 472 aa, Acinetobacter baumannii
PMSINPIELLKEKVSSTILNNQDGYLGEKTNALSKFYPILLSLLAAKPDLVGQLKNSLAPSLSDLFSHNEQIKNTVLTHLSGTAPNNEIENTLNSALKPSLNAISDVAGNDQQSIVNYLRQHAETIRSYLPGWAVGLLAPLGIGAGLSSVTSSTAPPLAAATETTGKSRGFLPIIALIILGLLIAWLWRSCQHKEATPAPETKAASGVEAAATPATLTLSTDDKGAVSQCQAGIGDQGFLATLQTQIKQVFSATKDCDVDTSQTYAAAFTDKDALAGVLGALKGIPNASLEWVGDKITLKAGDAAALEALTAKVKALVPHTEVVAAAPETAEQSVSNSLSASQTALTAIDPNNVDVNALVKALNLQIINFASGSSDIPADNKAILDQAATLLNKVSGVKLNVGGHTDSTGNAAANKALSQRRAQAVVDYLVSKGVDASKLVAKGHGSEQPVADNTTEEGRFKNRRIEFSVAQ

SEQ ID NO: 6871 - protein, 270 aa, Acinetobacter baumannii
MSAIIQMLKPHLQQAKKSKKGRKASKPRPVKVNRRVELYYTRQLLAISKYCQEKTKELVIPTVGQNIGDAWFSDMMTSFREKLTKYVVEISRPLATKVVTDTQKEVDKQIAEHTKTIIGVDLTPFYRAADIQDEVDLNITSNVSLIKSIPQQYADKLENLVTNALQTGQTNEDLAKEIKALGQSTDFRARLIASDQMGKINGQINKARQLSMGVETYTWQTAKDERVRPDHQHKQGQTFRWDSPPAGGHPGQPIRCRCTALPNYEDILIT

SEQ ID NO: 6872 - protein, 561 aa, Acinetobacter baumannii
TGAFIMTINNYDYDYLIIGSGFGGSVSACRLTEKGYSVAVMEMGRRWKAEDFAKNNWNTRRWIWRPGMKLFGYFNMRFFRHVTIICGNAVGGGSITYANTLLVPPEHIWDEGTWADAADWKNEMPQHYAEAERMLGVTDNKIFGPADHMLKKMGEAVGVGHTFKPTRVATFFPPEGEEGGKTYPDPYFNGEGPDRGTCTACGGCMTGCKHNAKNTLDKNYLYFAEKNGAKVYEETKVVDVKPLNGKADGSDGYEVTTECSSSWFNKQRRTWRVRNVIFSASSLGTQEMLFRLKQSGSLPNISDDLGNRVRTNAESILGVRFFGKDVDMSKGVAIGSSIYIDHDTHIEATRYQSGSDAMGLMCTYMAKGKPGWTRIFFWLWALICHPFIFLRMSNPVSFARQTLIFLVMQTADASINMRLKRNWFWPFGKVLSSEGKKLPVYIPQANAFTEKVAKMFNGHPMTTITEILFNVPFTAHCMGGCAIASSPERGVVDGQNRVFNYKNLYVVDGSMLGANLGVNPSLTITALAERAMSYIPAKHTLEEQAYTQTHNEVLEATKVSA

SEQ ID NO: 6873 - protein, 241 aa, Acinetobacter baumannii
VLQIMSSAIKPRSTKKLSQIIVEQLIEKIQSGEFKVGEKIPTELELIETFEVSRSVIREAITELRSLGFVETRHGIGTFVKEQTVEQNFLLSNASLETINDIISLLELRISLESEAVFLASERRKQIHIDKMKAALEDFERHISSDANDGTVKADYDFHIAIAEASENQYFVDFLKYLGEKIIPRARVKSIEQSPENREEYLKAVHHDHVNIYNAIVDQDGLLARQMMRAHLSKSIKKFKQ

SEQ ID NO: 6874 - protein, 64 aa, Acinetobacter baumannii
YDQIQILQMEKPTLLYFVFFVFSSDAKESFPYKFYSTHYCMDLKKTEFLPLNLYFSNVKIHTHS

SEQ ID NO: 6875 - protein, 492 aa, Acinetobacter baumannii
VFKMNNSEAIIKPSYDAKLTNQDLAPLKKQTWDAYNIFAFWMSDVHSVGGYVMAGSLFALGLNSWQVLLSLLIGIAIVQFFTNLIAKSSQQTGTPYPVICRATFGVLGANIPAVIRGLIAVAWYGIQTYLASSAFLLVILKFFPEWSVYADVSTYGFLGLSYLGWVGFMLLWLLQAIVFWSGMDSIRKFIDWAGPAVYVVMFAMAVWLIWKAGWQNIDLNLSGVQYDGFAVVPVMIGAIALVVSYFSGPMLNFGDFSRYGKSFNAIKMGNFLGLPINFLGFSLLTVVCIAATLPVYGKLITDPVEMVGKLDNTFVVILGSLTLMIATIGINIVANFVSPAFDFSNVSPSKISWRMGGMIAAVGSIFITPWNLFNNPQVIHYTIDILGAFIGPLFGVLLADFYLVKKQKIVVDDLYTLDTKGLYWYKNGYNHSAFYALIPASLIPILCVLLPQLSGLANFTWFIGMGFGFVIYRFLNQPLAHAKSAMTKVKVQ

SEQ ID NO: 6876 - protein, 134 aa, Acinetobacter baumannii
RLEIKMSQVKIYANERTIIQYRELLSHAIHQALIEELKYPVEKRFQRFISLKPENFIYPSDRSQHYIIIELSMFAGRSPATKKQLIQTLFRNIEEQCKIASQDIEITIFETPKENWGIRGKNADELLLNYQVNI

SEQ ID NO: 6877 - protein, 442 aa, Acinetobacter baumannii
TQRIEVPMKQKKLLKYIVVAILLGVLTGWICHHFFNEGEQLKQIASYFNIVTDIFLRLIKMIIAPLVFATIVCGIVSMGKSTSIGSITLKSMTWFITASFVSLAIGMGLANFFQPGAALDLALPTAQQLSSSSLPTTTGFTLQSFLSHVFPRSIAEAMANNDILQVLVFSIFFGSALAFVNQGKEKDSVIIRLTDELSKIMFRITDYVMMFAPFAVFAAIASAITVQGLGLIVDYGILIAEFYFGLLLLWVILFSVGAIVLKKDIFRLGKLIREPVTLAFATASSESAYPKVMDALNKFGVPKKVTSFVLPLGYSFNLDGSMMYTTFAVLFIAQAYNIDLSFTQQILILLTLMVTSKGIAGVSRASIVVISATLTMFHLPEAGILLLLGIDQFLDMGRTATNVVGNSIATAVVAKLEGDKLADTEELPEPVLIKSTQEQTIA

SEQ ID NO: 6878 - protein, 136 aa, Acinetobacter baumannii
IHLVWRIEYMSNEKFEKGLAIRKQVLGEEYVNNSINNADEFNLPLQELVTEYCWGAVWGREELSKPERSLINLAMISALNRPHELKLHVKGALRNGVPKEKIREVLLQVAIYCGVPAAVDSFRIAKEAIKEFESEQ

SEQ ID NO: 6879 - protein, 411 aa, Acinetobacter baumannii
GAIVMTSYQSVQTKQTSASGQAHIIQNDAEALEIAEQFAEQFKKTAVERDAKRILPYTEIDALSQSGLWAITVPKQYGGAEVSSHTVAKVIALLSGADGSIGQIPQNHFYALEVLRNTGTETQKQRLYGEVLNGTRFGNALAEFKTKTSTHKQTNIRPHENGYLIQGEKFYCTGSLFAHRIPTLVLDDAGREYLAFVKSGSQGLKLVDDWSGFGQKTTGSGTVKFDQVFVDADDVIPFDTAFLQPTLVGPFAQIMHASIEVGIARAAFEESLQRVHQARPWIDSNVETANQDPLTIYELGRIAVDVRASEVLLKQAAQSIDAAKIETTPENIAKASIDVAKVRAHSTDIALKASSKLIELAGSRGSQSQDGLDRFWRNARVHTLHDAARWKYYFIGNYVLNGVLPPRRGTL

SEQ ID NO: 6880 - protein, 330 aa, Acinetobacter baumannii
YGIVHLYVITQNKDILFRSPIMNKSMVYAYTGVVITMLFWGSAFNAMSYVIQYMPPLSAAAERFTIASLGLFILFAAIGKLRWAALRQNLAIYLIIGIIGIAGFNLGCFYGLQTTSAVNGALIMATTPLITLLLTILLDGEKLTLNKSIGVVFGLSGVLFVISHGHISTLLHLKIAIGDLFILLGGVSFCLANVLSRRYVKNATPLETTTFSMMFGALTLIILSVIFEHPSQAIAMAPITAHLAMGYVIICSTMIAYLFWFNGIQKLGAGRASIFFNFVPVFSMLVALLAGQSLNIWQLIGTALVMLGVMSSGGFIQIKRPALIAKPCTK

SEQ ID NO: 6881 - protein, 285 aa, Acinetobacter baumannii
KLAVDRAERFSLDLWLYFYFVFSDLLSLISFGGTFRKGLGVIMPLLSIQQLQKSFAQSHILQGIDLDVEQGEVVVILGPSGCGKSTLLRCINGLEPIQGGEIRLTGSGVLGKDVDWTNARQKIGMVFQNYELFGHMNVIDNILLGPLKVQKRHRDEAEQVADELLKRVGLYERKLDYPRQLSGGQKQRIAIVRSLVMQPQVILLDEITAALDPEMVREVLDVVLKLANEGMTMLIVTHEMSFARKVADRIIFMDKGKIIEQASPEEFFEQPKTERAKAFLNILSY

SEQ ID NO: 6882 - protein, 261 aa, Acinetobacter baumannii
IEAVMQELIKASTATDGVLLLTLNRPEKRNALNKATLQCLCELLEEAEHNAQVKAVVLTGNAQCFAAGADLSELAAMDAVSLQLDIRPKLWQKIDAFSKPLITAVNGYALGAGFELVLHSDMVICGENARFALPEIGLGMLPGAGGTQRLARLVGQQLTMRWAMTGEMISAKQAEQHGICSQVVPTELTVEYAVQLAAKIAKQAPLAIRVIKQSIKSIHETTLSQGLKFERQNFVWLAATKDRNEGINAFFEKRKPVFRGE

SEQ ID NO: 6883 - protein, 83 aa, Acinetobacter baumannii
RFYVITLKGTFMSLQRGIYQHYKGNLYQVFSVAKHSETEEELVVYQCLYGDYSTWVRPLDMFTETVQMSDGSIVPRFKLIQST

SEQ ID NO: 6884 - protein, 167 aa, Acinetobacter baumannii
VVYVALQVLLCRGSFYSGFILGNSHFKLGRRYGLPLSLVSLFIFLCWLLLPYFPKYGLLWACVAMGLQNAMVSHYKGTIIRTTHLSGVLTDLGLALGYIARGLKVENRRIILHLLIFIGFLSGGIIAALVHPYLKLQSFLLPAILSLTLSISYWAVYFHSSSSSNSD

SEQ ID NO: 6885 - protein, 317 aa, Acinetobacter baumannii
IIHVNIIPKWNNLFFIMLSLKSLQCFVTLVKTKSFTRTAEELYLTQPTISKILQQLEEQLQVQLLVKPDHGRKRQIELTEIGERIYQHAVELLQAEQNIFLEIENYQQLKTGTLKLGVPPLGSQLLTTALFDFHRQWPDIELAFMEVGSRGIEQALLNNELDVGVLLQPFDEQTFNSIELCNYPLMVLLRRDATWATRKKINLEELQHQSFLMFPENFSLNSIILDACKQHGFYPTIACRTSQWHLLADMVLQRMGIALLPQYYTDMLDPTLFAAVPLEKPNIQWHLVMAWKKNLPVSPAVQAWLSIVRQHFQHIKP

SEQ ID NO: 6886 - protein, 218 aa, Acinetobacter baumannii
KYNVILVFYLKGAIFPPHYLIRIKALKSNKAIFIEYSGDFMKKFIFIAASSLFNIAAAQAADGTITINGLVTDNTCTIDTGDKNLTVNLPTVSSQSLKNAGDVAGRTPFQINLTNCASVGKVATYFEPGATVDFNTGRLLNQATSGAAANVNIQLLGSNNAVIPVIAKGASGAQDNSQWVNVSAGGNADLNYYAEYYATGASTAGTVTSQVKYTIIYQ

SEQ ID NO: 6887 - protein, 114 aa, Acinetobacter baumannii
MKDVMGNGFIANAEAFTLATQIYVRMRRVTGRVIDAMYVVQNKDYAKYVIALALEAEDDELKRCVERLMVLTDSIPEQSQKEMTVSIQTSEESEITAEDIYRAQVPHHYIGALR

SEQ ID NO: 6888 - protein, 462 aa, Acinetobacter baumannii
QCRVYLLSTLGDAQMERDVLSEINHNNMSRYQWFIILICICLNIIDGFDVMVMAFTAPSVSAEWSLSGAQIGLLLSSGLFGMAAGSIFLAPLADKIGRRLLILVCLVIAGLSMLGCALVQSHGMLAALRFITGIGVGGILASSNVLASEYANARWRSLAVSLMSTGYGIGATLGGVLSLALIEHLGWRSIFLAGGITTIVMLLISAWLLPESLDYLLAKRPKQALERINATVNRMGLPALKALPYYGQNNQKNTGDIGKLFSGQQGLQTLCLWFAFFLVMFGFYFVMSWTPKILISMGMSPEQGVSTGILISIGGIFGAAIIGLLASRMKIFYALSLFLGLTAVCVFLFIAVSSQVSIALIVGLLLGTLINGCVAGLYSISPTIYDAEIRSRGVGYAIGFGRIGAILSPTVAGIFLDKGIAPATLYAYYGVVFILAIFLILSLGSAFYRSKKEQNFSLKTAP

SEQ ID NO: 6889 - protein, 1202 aa, Acinetobacter baumannii
TLRVKLCCGRIKDWFMQFVHLGIYTEFSITESIVRIPDLVKTAVKDEMPALALTDLSNLHAAVKFYNSCLKKGIKPILGSTIRLNDAQHRATLLAMSDIGWKGLTEIVSRGFIEGQQLSIPCVQKEWVLEQHQDIIVLLGQHSDVGQMLCSSNPQKAEPLLEEWIEKFGNRVYLALTRTDRPGEEDFIQEAAKLAAKYNIGVVAHNDVHFIEKEDFEAHEARVCIADGYVLADDRRPRLYSPEQYFKTSDEMIELFSDIPSAIENTYQIAKRCNVTLKLGTYFLPEYPIPDGFTIDTYFEHLSKEGLEERLNYLYPVEKRGEDWPEIRKPYDERIDYEVGIILKMGFPGYFLIVMDFIQWAKNNGVPVGPGRGSGAGSLVAYSLKITDLDPLRYDLLFERFLNPERVSMPDFDVDFCIAGRDRVIDYVSRTYGREAVSQIATFGTMAAKGAIRDVARVLGKSYGLADRISKMVPTKPLGVDLATAIEMEPQLKDIVTNPSNPDNDDASEIWEMALKLEGITRNTGKHAGGVVIAPGKITDFSAVLCDADGTNRVAQYDKDDVEAAGLVKFDFLGLRNLTVIEDAIQNINKNRDSNDPLNISHVPLDDPKAYSVFADANTTAVFQFESVGMKRMLKEARPSKFEEIIAFVSLYRPGPMDLIPDFIHRMHGGEFEYLHPLLEGVLEPTYGIMVYQEQVMQTAQICAGYTLGGADLLRRAMGKKKPEEMVKQRQIFLEGAGQKGIDESTANHIFDYMEKFAGYGFNKSHAAAYALVAYHTAWLKAHYPAEFMAAVMSSEMQNTDSVVFLIDDCRNNGLEVLPPSVNMSTYHFHASDDKTIVYGLGAIKGVGEQAMQSVIDSRRQQGPYTDLFDFCHRIDLKKINKRTLEALIRAGALDCLGIERSSLMAQLPEAVQAAEQARSNRESGIMDLFGEVEEVQRKPAKPVKPWSDEVRLKGEKDTLGLYLTGHPIDVYRQELKAFIPAKLNEITATRRGVTTVYAGLVLDVANFPNRVVIVLDDGTARIEVSCNHERFQRFKDIIQVERVVVFEGEIYEREGFDRPMGRLNKAFSLNEIRQKRANSIQIKLTHDLLQPSLAKDLQNILLPYCNVDMHQHIAIQLQIDQPYAQAELQLGPQWKVAPLDELLAKLRDYFGKDNIHIEYQVKSKAAKAAEPVRPQPVASPPVDMTIDDALDSYQSEVSQYS

SEQ ID NO: 6890 - protein, 324 aa, Acinetobacter baumannii
SEGVTMISTTVKKSLNKIKFYREIELPDFASKKSIPIRHLNIGFEGKEIDVEFYMNNQFATMFFATLSVFLTYGEDLVIETARHHREFIQDPVLKQRVTSLIGQEAIHSKLHNEYNDALKDVEYPVDLYRFLGENFFKYVFLKFPQPLKLSMMAGIEHFTAVLAEYMMKHEKNFYYSDDAKSRALWMWHMLEESEHKDIAYDVYQLLNGSYALRASGFFIALFTILGLIPATTLFIPVLRKPQEMLTRKFWKDARRGVGLLFGPKDGVFGSTIGQIFDYLRPDFHPNDHDTTEYLEYYKDKLLKEGGAIAPYFVKEFTPPVRLS

SEQ ID NO: 6891 - protein, 375 aa, Acinetobacter baumannii
PICLGYSAMRTDAIVIGAGIVGAACAYELARQGLNVQVLDARIGGATAAGMGHLVIMDDLEAELKLSHWSVQLWHELGHELSEECAYRQTPTLWLASSAEEMQIAEEKYQRLTAQGVRCQLRNADEVHQLEPHLKQGLYGGLEVFDDGILYAPCAAEWLLKKIPHKVQVQQAKVIHIKENRVQLSDGTWLEAAHIVLANGIHATDFFPELPIEPKKGHLAITDRYPELNVKHTLVALAYAASTQATSGISVACNIQPRPTGQLFIGSSRQFNTVDPTVEPEVFTRVLKEAVDYFPALADLNVIRAWTGFRAATPDGIPVIGRHPAFQSVYLAVGHEGLGVTTATGTARLIASHICGLTFDIDPEPFLPHRFIGAA

SEQ ID NO: 6892 - protein, 169 aa, Acinetobacter baumannii
SNCLAYAQAYISSKTISRLKQKDKTVPKQKLARISITVPETTLNALDQKIVEQNYESRSQAIVDMINKHLIAEQAQANEVMVGTLTLLYDASQMTLRNQLVDLQQQFLAQVISSLHIQLDQQKILQVMLMQGASSELRQISQQFIVLKGVIKGHLELMDAVMPPIQQND

SEQ ID NO: 6893 - protein, 154 aa, Acinetobacter baumannii
LDCLIMQGRFMESPKYTGLEFLTALKNGEVSPSPMAHTIPMELVEVSEGKATYKVTPRKEHRNIQGGVHGGFCATALDTATGSAAHTLLEHGVGYGTIDLNVKMIRPMQVDTSYYATAELINAGRNIISTQGKIVDENGKVYAFASATLMIIRK

SEQ ID NO: 6894 - protein, 260 aa, Acinetobacter baumannii
DNAVKNIILATIMGFSGISSVFAECTYSFDATLTQLQSLGNTSVQKFPTITGNKFSYKTSQQSPIYSAYSQDYLTRALATNDPQASLYTRGDKILPTTGIIAFEYKIKVPTLGNTGYVNIFPALSGGIMQNGKAVHFIVAYQHGPTTNNFYFQTTSNDSALVTNGFSLAPEVTSDGYQKIGIYINQNSNQVGLVFNGVNKGYFATFPSKLDNLYFSLTSNYFDLAATDANKDVSVEFLLDQSKITQTYPTGTKDICGVAL

SEQ ID NO: 6895 - protein, 500 aa, Acinetobacter baumannii
TNAVCRFCKRHLLLVQCIFYFVISCSPYMYKSEQLAHSIRQLIESGTLNAHEKLPSLRDQVQRSGFSLMTVMNAYQELESQGLIYSKEKSGYFVAEQIALKPLEQYSIVSLNSKIEINSLVFKYLKSIQHESVVPFGSAFPDSQLLAAPKLIQIMGQLARQRQSYDQTTSLPPGNLALRKLIAQRYCMQGIQTDPDDIVITSGGLDALNLSLQAVAKPGDYILLQQTVFYGAWQAAERLGLKVITIPEHPQHGFDLEAFEQVIHTYPIKVCWLMLNSHNPIGFTVSDEIKYKIAKLLHEHQIYLIEDDVYEELYYGGQKPLSMKYFDQQNLVLHCSSFSKTLGAGFRVGWVYAGKFSDHIQHLQLMSTISVNALIQNALVEFLSHHHYEKHLRTLRLSLERYKKQFYHYLKQHLPATCEIYYYPSGYFLWVKLPHKLDSMQIYEELIQQDIGVAPSPLFSVLPAQQHYLRINCSFEWNEKIQAALDQVIKTIQQRVEASL

SEQ ID NO: 6896 - protein, 544 aa, Acinetobacter baumannii
LSNVRRSTFDVHSQVRLIMLNITGQNFIAGQRSSAGSKFVLSYDAATDEALPYQFAQATPEEIDQAAQAAALAYPAFRQTTPEQRAVFLETIASEIDALDDQFIATVCQETALPEARIRGERGRTTGQLRLFAQVLRRGDYLGARIDLALPERQPLPRPDLRQYKIGVGPVAVFGASNFPLAFSTAGGDTASALAAGCPVIVKAHSGHMATAESIANAICSAIEKCAMPKGIFSMIYGQGVGEPLVKHPAIKAVGFTGSLKGGRALCDLAAARPEPIPVFAEMSSINPMILLPEALKVRGDKIATELSGSVVLGCGQFCTNPGLIIGIKSPEFSQFLDHFKAAMAQQPPQTMLNKGTLRSYEHGLKELLAHDKIEHLAGQPQQGPQAYPQLFKADVSLLLEHDELLQEEVFGPTTIVIEVESAEQLAQALNGLRGQLTASLIAEPQDFENFATLIPLLEEKAGRLLLNGYPTGVEVCDAMVHGGPYPATSDARGTSVGTLAIERYLRPVCYQNYPDHLLPLALQNANPLGIARLVNGEMSKAAL

SEQ ID NO: 6897 - protein, 178 aa, Acinetobacter baumannii
TERFNLKNTVKLSWRIRDLICTKASIYLFLLSTSLGKIRAAYVRSKEKMMKKLMLAVAPVVLALTACATTTGTGTGGASAQTTTQQLGVAALKVAVNAKCITEINNVAAWKTATKYMTAEQRDSIQTNVCGCVSEKAPNSVTAVELAAAALDVNARATIVNQVVSKTVNACVAEALQK

SEQ ID NO: 6898 - protein, 204 aa, Acinetobacter baumannii
KQRLIHNHSLSKHVYRHVCSYFKENKISIFLRPLQYTEIDLIWQQINRRELITQLYLQKQEHLELTDCFYDVKHWDAYHLENDPPKLKELYEQGALFIGAFDASEQLAGISVVSNQTITDYPDAKLLQYFYVDADQQGKGIGAKLMQAAKESAKQLEAHQLYISATPSKRTVDFYIKHGAVVLKHPDRQLWELEPEDIHLLCTL

SEQ ID NO: 6899 - protein, 66 aa, Acinetobacter baumannii
KQIVKIKIRLLLSKIHIRIKILLNQIEYLKNLKIILSSFYNIRLNKIMFLIMINLIKILKSISSNN

SEQ ID NO: 6900 - protein, 129 aa, Acinetobacter baumannii
MEPVSTSGFTALLKLYGIAIMVTLAVGLVAAVVLMTRMPRSPQEWAVGLICTVVSSLAGGSFIIVKWGLHEWVTDVWGMIALGGFFFVCGLPGWALVRWIFNFIDKQEGKTIVEVIKEFKKAKDDIRNS

SEQ ID NO: 6901 - protein, 589 aa, Acinetobacter baumannii
FGKVVAVTTIRSGKKRIRRIKENDSMQQERLSYASGPSTQPLLGMTIGEQFDQACQQYAEKEAIVSFHQNRRLTYKALQDEVNAFACSLLKLGLKKGDRLAIWSPNCVEWTITQFAAFKAGIILVNLNTAYKSHELEYVLNKVSCKGLIIASQFKTTDYQELLTKIAPELTTCTDKVLSSERLPHLKFVIKIDDQQHTGIYRFSDLLTTPTSEQLEQLKQLARQLQFDETINIQFTSGTTGNPKGTMLTHHNILNNGYFVGEGIRLTPQDKVCISVPLFHCFGMVMGNLACVTHGATMVYPSAVFNPLETLKAIHQERCTAAYGVPTMFIATLEHEQFNEFDLSSLRTGIMAGSPCPREIMQRVIDRMHMSEITICYGMTETSPVSVQSSVNDSIDKRVSTVGHVHPHVEIKIVDLEGQIVPQGTLGELCVRGYSVMAGYWGEEEKTREVIDAAGWMHTGDIAEMDQEGFIKIKGRIKDVVIRGGENLFPKEIEDFLYTHPDVSDVQVIGLPDAKYGEELCACIILHEHHQVDEDSIRQFCKEHISHNKVPRYVRFFNEFPMTASGKAQKFKLQEIMRAELNLTGNVFD

SEQ ID NO: 6902 - protein, 214 aa, Acinetobacter baumannii
GFRVAFVSVKEVADKAQHFSVHEQMIIGINYCLGLNGHEQDINEGRAWLWIAATYYRSFIAQYNWALTWTSMPCYKVEKDISLEELQILANENNLAAIYMLGVHFREPDPILAIEYYQKAAKENFYPAINNLADIYENGSGVEQNINKAVELYNIAAEQGIAAAEWSLGLLYFNGDLVDQNIPLAQYWLQKAEANGWFPAQDLLISIDENYQKI

SEQ ID NO: 6903 - protein, 206 aa, Acinetobacter baumannii
LIMVYNFFVESEAMPKHGKNFNDATRVQHITPISAGSLTGSYTFIELLVNSSDGVMRRILIPLATILKEESNINSEVVAMKAQQIQHSGDVSQNIFLAVMILIMIIVLLISPFSIETLLSCFVTIFCLANDLVKCYNKTAISYLQNCTQVESEAMPKHGKNFNDATRVQHITPISAGSLTGSYTFIEKLVNSSDGVMRRITSYLYG

SEQ ID NO: 6904 - protein, 154 aa, Acinetobacter baumannii
KVMVRSNLVQKKVEDEPKLSYMIARVDRIISKHLTEHLKELEITLPQFTALSVLASKSNLSNAKLAERSFIKPQSANKILQDLLVNGWIEKKPDPTHGRRILITLTESGIEKLNKCNEVVLKVEEKMLEGIDINLAYLIRNNLDIMVNNLKNFK

SEQ ID NO: 6905 - protein, 369 aa, Acinetobacter baumannii
RYVVSRLEIRRMTMVSFGSQVDFSLPHIKIRGLNKFYQSQGQKLHALKEINLDIPQGKILGIIGKSGAGKSSLLRTLNGLEQVNTGSIHIHQQNIAELSHSELIQTRQRIGMIFQHFNLMSAKTVWENVALPLKVSNYNKADIDQRVNEVLALVGLADKSNYYPSQLSGGQKQRVGIARALVHHPEILLCDEATSALDPESTATILALLKKINQELGLTIVLITHEMQVIREICDQVVVIDQGEIVEAGQVWSVFSRPEQQITQELLNLEQITLPFKISRLPDEDSTHIIVKLKYEAEAHQVPDIQELLAKFKAPVNLYQSQVDTIQGHIIGSLLVGIPNVEIDLSSIQQDALTAIAQFEVLGYARPAH

SEQ ID NO: 6906 - protein, 143 aa, Acinetobacter baumannii
KVQVMGKVNKTDREWQRELSPEEYRITRQKGTEPAFTGQYWNTKQHGTYVCRCCGAELFSSDAKYDSGCGWPSFFRPLNGSVIDEHEDLTHGMVRTEIVCHDCEAHLGHVFEDGPQPTGLRYCVNSASLQLKTQEKNDEETYP

SEQ ID NO: 6907 - protein, 248 aa, Acinetobacter baumannii
ALRVYDWQDFEPFNFNMTNTFSDHKQVEVVSTFAELVNTHFQGNKNAICWHRNLVGDFKEIVAKLELKENITEISTEDLLALELSEQGDLARDIILKDMQLLTDMGASPVLNLLKHYERDEELDFISTDVYSFHVDRSPIETDTFLCTYHGTTSDIVPNDQVEQKVLIPEIREKLKALHDGPEAEFESFLAEYFFDLHYQPKPDAQPINLGIGHIWRLAVDHPTQKVLPCVHRAPVENDGEYRLLLIC

SEQ ID NO: 6908 - protein, 379 aa, Acinetobacter baumannii
AQFFGTIHHLILSKFSLSMTSSYRQQLQAKIDRITTQFSEFTPPTLEVFESPEQHFRMRAEFRIWHTENDMFYAMFERNDDGKQKTVVRIDEFPIADKSINDLMPLLLAELKANSLLSQRLFEIDFLATLSGEMLVTLIYHRKLNQEWEQAAKALAEKLNIKIMGRSRGQKIVIGDDFVVEEFELLNRSFKYKQIESSFTQPNAQVCKKMLQWACDAAEGSKKHLLELYCGNGNFTLPLSLKFERVLATELAKSSVYAAQWNIEQNQIDNIQVARLSAEEFTQAYQGEREFRRLQEADIDIQSYDFDTVFVDPPRAGIDDETLKLLQGFERIIYISCNPDTLYENLKTLTQTHRITKFALFDQFPYTHHVESGILLEKI

SEQ ID NO: 6909 - protein, 83 aa, Acinetobacter baumannii
TKFFNVTLFYKEIKYLLIFQDVLIKYLNLKKISSHLFVIISFNSTITIENSLVQLVDLSHIESCILIYIGYISSYVRLYMKAL

SEQ ID NO: 6910 - protein, 123 aa, Acinetobacter baumannii
IFLFSIIYNNIEEEEMPKYLAIAEKVYKEIKKDNLFTEDTIQNLNCLISLIRKAIKGTEFKLKYNFINFEECLNQFNKEKSVHIDLSLLPRFEYRDEFILWLTNFIRNISVQKKFVKQKYYFN

SEQ ID NO: 6911 - protein, 302 aa, Acinetobacter baumannii
MDLFCRAKYNGKTIALIIFEDRMSQNTETEKPINFDEIRLDPISHIHRENNPQFIASLARGLELLRCFSANNQVLGNQELAKMTGLPKPTIARITNTLVSLGYLKQLPNSTKYTLDIGVLSLGYAALSNISIRNIAHQYMEEMSQYVQAPVAMATRDRLNMVYIDVVQIETALNMRRPIGSTLPIHSSSMGRACLAATPERERNFLLDALKQKNPENWPAIKRSLERAFRDYQDYGYCLSLGEWHKEVNSVAVPLVSSKHGLYVFNCGAPSFHLNPEKLEGEIGPRLIHMVHNIQDALNETH

SEQ ID NO: 6912 - protein, 470 aa, Acinetobacter baumannii
RHLFHGYANRSIIKKSLYMDNLQTNIAVVTQQRAKHTKTRYYILAMIFLVTAFNYGDRATLSMAATPMSHELGIDSVTMGYIFSAFAWAYVIGQIPGGWLLDKFGARRVYFWSLFLWSLFTVLIGFTDILGDTATIITSLFVLRFLVGLSESPAFPGNSKIAAAWFPTKERGTAAAIFNSSSYFSTVLFAPLMGWLVATVHWQSIFWVMGGLGIILSFIWLKVIYSPTNHPTVNPEEVKYIASEGALLDMGENSQNAKKEKITWSKVKQLLASRMMLGIFIGQYCVNTLTYFFLTWFPVYLVKERHLSILEAGFAAVAPALCGFIGGILGGLISDKLIRMNYSLSFSRKLPIVVGFLVSTSIILCNYVDSQAAIVFFMSLSFFGKGIGSLGWAVMSDVAPKEMVGLSGGMMNAFGNTAGIVTPIVIGYILASTGSFNLALTYVGIHAIAAVICYTVIVGKIQRFELKPTS

SEQ ID NO: 6913 - protein, 63 aa, Acinetobacter baumannii
TVVFKIFIMKFSFRPLSSLKSLDILFVMYLSKIDPLKFAFLSQERRSLIFFRSTLPSAAKATF

SEQ ID NO: 6914 - protein, 95 aa, Acinetobacter baumannii
QAVFTQSTRKSLSFLWASLRAPSAAEREGDIFGCADFWVNQSANPFSFRHHNHLAVMWRNFFLTQRSSHMRTISYLLAFAKSSLFIPPKQSLKRL

SEQ ID NO: 6915 - protein, 78 aa, Acinetobacter baumannii
YEVLKMSTTNNQANQRNNQQQQQQQNDNRNQQQHGNQQQNDQQQQNNQQQQQNDNRGQQQGSNQKDSGQQNSNNNQQR

SEQ ID NO: 6916 - protein, 287 aa, Acinetobacter baumannii
WYSFMFDPRLLRAFVTIFESGSFTAAADKLHLTQSTISQQLARLEESVGHSLIDRTARPLQLTASGEYLIGYAQRILTLQQEAEAVLKDPAGSNPIRIGLPEDMMSTAMAEVFGLFAQEHRTIRLDVTSGLSRNLTERYRNGELDIVIVKESAASADCYASFPEEMAWFESENAITPLSEPIRLVTFPQGGLYRDEMFETLERERRRWYIAFTGSSLESVLVSVETGLGISLLPVSTTKGRRVRRYKSLGEASPMVVSIYTWEKAGLISQLVDHMTTVLHDRFQSGS

SEQ ID NO: 6917 - protein, 251 aa, Acinetobacter baumannii
AKSFDLAFREFAMSAYTIIFAPIAQATRSEQVVERLENAIISGLLKSNEQLPNEADLARLMGVSPITVREALNTLRVKGLIDTRRGRNGGSFVCELPSDLLLNQHPLRQASNEYLADLGEFHSAILSHSAYLAAQRTTEYELNKIKELIDQFKQAVEADTRAQLDLRCLLTLTSFAQSSRLANQELTIQAEWAPLIAVLYQDDDFHREVVKQYHHLLSSFIDNNENEAVIQARKIVSMLTDQMLRYKLSSE

SEQ ID NO: 6918 - protein, 75 aa, Acinetobacter baumannii
RGAFMANTAVVTSWKYNATSRHLKIFYSDGSGDLYHPVPEFVYDNLLRSTDKAAFVHKYLEFNLHFTRLSLVIAS

SEQ ID NO: 6919 - protein, 252 aa, Acinetobacter baumannii
GLALMKILVLCIVNFIIFTQSALALEYRQIRNTTDDQFEVIEISNLEQLRLFLKNPQTDQYYKSFDNIQYQLKACEQLTFAMNGGMFHSGFSPVGLYIENGRESQPLNEDKGWGNFFLQPNGVLAWNDKQAVILTTEQYKAKVFQPDYATQSGPMLVINGKISPLFLANSDSKKIRNGVGIKNNKLYFVISKNRVNFYSFAQFFQKNLEVEQALYLDGSISSLYLHKNNRNDKKFNMGPIIGWVDQADCRPK

SEQ ID NO: 6920 - protein, 102 aa, Acinetobacter baumannii
DSKFSFPDFLIIENHIFLASEFDQDKFNNLRKMEEINRTQFWMNLIEFTSLHDEMTVEQALLIAQKIVDSWNAKIKYEGLNAHGRARVFEEVEYGEIFITID

SEQ ID NO: 6921 - protein, 168 aa, Acinetobacter baumannii
IYKFYQFEFLIMIFFEPEQYQQRCTQLFNLYRKQISALLPSAQIEHIGSSAIPNAFSKGDLDIYIEVLPDQFEFAIEQLKTLNFIEKQNTLRTNELCMLESLNNDDVAFQVVVTGSIFTFFLTFRDKLIASPTLVNEYNQLKLQSTHLDHDQYRAVKSNFIERVLSHS

SEQ ID NO: 6922 - protein, 61 aa, Acinetobacter baumannii
LGKFKSHSTKSYWPRFQVSNLNNKYKKKLSHSFEVIRHDSPNNQFLPLFNINILIIRIFCF

SEQ ID NO: 6923 - protein, 148 aa, Acinetobacter baumannii
EAKFMKKIIFLGLALVSLTACSSVQHKDSTPPKIGSPNPASQYCVEQGGKLEIRNEANGQVGYCHLPNGQVVEEWKLFRDNQANCVSEEAQKLVGQSGLTDDQIKQKTKSEIIRKVAPGQPMTMDYRSNRVTVTIDPTSKKITQATCG

SEQ ID NO: 6924 - protein, 296 aa, Acinetobacter baumannii
MLKLGQNFGSLAGSNNGKIMAIQFKQHKPWLLGITILIVVLGLVGYRYIKNKQADDVLTIGISPPYAELLQSVANEVEKQGVHVKLVEFSDWRAPNIAVQNGDIDANFFQQSVFLRNAVKETGYDLHAFGVGSGSHVGLYSKKYKSLEDLPLNARVAIPNDPVNLARALILLHRAGLIQLKDINNELSTTQDIIANPKQLSFVEVEGPQTAHAYNDVDLIFGFPHYLKMAKVTDPHSALFLDPIDKKYAILFVTRRDYQDKNQKLATFVKAFQNSKQAQDILDKDFGKGMWFQGWK

SEQ ID NO: 6925 - protein, 66 aa, Acinetobacter baumannii
FIELVTVNKTPGPGLDKVRKAMVIKTKRPLTLILPVYHQYVNCMPTLKQNRNYVYRQVCIIYKKVN

SEQ ID NO: 6926 - protein, 984 aa, Acinetobacter baumannii
AKSSHNAVDLFEKHYNILYDGLKGGSSTHLSRRHSQNISPSVMTFPLEFKTLKPALKSFIATLFEDNPYQFQPVFRGFYFTSALQEGVIESPMTEQIAQEFQLSQIAQSEVKDQLKTTPNHGYFLKGLFSDVILKDKDLVKQHVNTSKKRQRYIAFIGALAGVSIILGVWVWSYRNNQQLIAEVQADLNKVVQLEKSSGQQLSTQLEALLILQRRLQQLDEFDENRPLKFSFGLYQGNELREKLKAEYLKGVKQIVLIPTQQNIAQYLQRVKNNEATLKANHTNVEIKQTAQTQQYLEPSDTNPQDAYNALKAYLMMSNPQYMDASHLSDQVTRFWRSWLDANKGQMPRADMIQEAEQILSYAMTLANDKQFPILDADSQLVDQTRQVLLSVIRGMPARDRVYNEIKMRAAVRFPALTVSQIVGDANKNIVLGSYALPGVFTQKAWNEYVEKAIEEAADKPTDTKDWVLNSRQSDDLTFSGSPEQIRKQLTALYKQEYIAEWRKFLSGIHYAKATQFAQQVKNIDVLGEPQNSPIRTLIERVAIETNWDNPVVQAELAAPQKGFIAWFKRKVLNHDDKQLANQTVTNAQGPISQEYQMFYQLVRKRDDQQGKSLLDEYMTNLALVRSKFNELKNAGEIGPNAMTLVKQTLNEQTSVFNQTQKIVDEKMAVGFSEIDQQLLQKLVVSPLTQAFESLITPTQDEINKLWVMQAYQPFTANLAKKYPFNSSASLQATSSEIGQILGENGSISRFVKESLDPFVIRRGYTLTSKTWKDLGISLNPQFVMNFQRYVAPTNGMATGELNSQAPAAPATNQSNFQFYPIQNPQLLSYTVDIDGQRMTYENGVQQWVNFIWPNQGSIPGARITAVDLQGQTHTIFDEPGEYGINRLIDSAQRKEQNGGFEMLWRSKTDPSLFVKMNFRLISSNSGSIGSSRGYSGMQLVDKVTADKAARVVSAQQAPAQAAAPAKTENPVSALAQPAAGVKP

SEQ ID NO: 6927 - protein, 99 aa, Acinetobacter baumannii
YEEFIVNIQQKDDTKHGSFSLLDGETVAGEMTYTWAGESMLIIDATDVNENYRGQGVGRQLLDALVAFVREKDVKVIPLCPYAKSVFDKDPSIGDVLRK

SEQ ID NO: 6928 - protein, 723 aa, Acinetobacter baumannii
YFNSGVRSTTMMTKINYQPWLQAVLTIAKHYRIEPSEERIRLQLDWNQNQNLDNVLQLMTRQVGLNLRKAPFSLDLLNPWRLPVMVEFNDGQVGVIDKADTQGNVSIQFSGDQGLSQSLSLDALKTTLKNVYILRPETSIPDARIDEYIKPYEANWFWSIVLRDWKRYVDIMFASLIANVLALATIIFSMQVYDRVVPSQSIPTLWVLAGGVLIAALFEFTLRVSRVYLSDIIGKRADLRVSDRVFGHALRIKNKDRSKSTGSFISQIRELESVRELVTSTTISAIADFPFFFLFLVIFAIIGGKLFWVMLLVVPLMILPGILVQKKLAQLAQEGMRESSIRNAILVEAVQGIEDIKLLRAESRFQNQWNHMNEVSADIGMRQRKIVGTLMAWTQMVQGLTYAIVVLVGCFAVMDGEMTTGALVACSILSSRMLGPIAQITGVLGRLQQAKVAKQSLDELMQRPIDQADRSHLVHKAVLNGDYELKNILFQYGEEDPRPSLAIRHLKIRAGEKIAILGRNGAGKSTLLQLLSGMQVPTQGAVHLDGLDLSLIDPSDVRRDMGLLNQNAHLFYGTIRENLTLGAPLATDEDILRALVVTGALSFVQEKKEGLDYLVLEGGVGFSGGQKQALLLARLLIRQPNILLLDEPTAAIDDVAEKQLIDHLKGWLAHRTLVVATHRRAVLELVDRIIVVNEGKIVMDGPRDQVLNQSTAQQKQVSQGGNS

SEQ ID NO: 6929 - protein, 160 aa, Acinetobacter baumannii
YPNSDNYSCQIYFRGNKMLKTQKINIVQEFDAPVDKVFAALSEHENLSKLFAPAKVTRISNGKDARNGVGSARKMSIPFTPSFVETNLVYKENELIEYAITSGISPIKAHRGVMQFTDLGNNRTRLNYTISFKGRVPFIGPIIKAALENGVSRGLKKLKF

SEQ ID NO: 6930 - protein, 197 aa, Acinetobacter baumannii
QVCSNMSRPVLNGGKMIFNRGSAFIISYFLISLVNAGEIGAKLTSQIELLPSCSVNNNVVENNAANLSFGTIDFGEATTAFKGVLEANLVNNGNSGFQIECAGISTVKIIFGAGNNDSNIPASFSQNYYHALSNGRDFIAYNLLYGLNKQVIKANEAFILNDMNNKKNIDIFGQAAHDGSRISKGEYKDIVPITIEF

SEQ ID NO: 6931 - protein, 169 aa, Acinetobacter baumannii
HFGSQLLYNSNYLLFLPLLMLAQFDVNLVVLLVLLICGLLSQNAAVTIAAGILIVIKITPLNQFFPYIQAHGLNLGILILTIGVLTPIASGKLSGESILKSFISFKSLVAIAIGLLVAWLGGRGVKLMSSQPDVVAGLLIGTVAGVALLRGVPVGPLIAAGLLSLFIGK

SEQ ID NO: 6932 - protein, 613 aa, Acinetobacter baumannii
RAFLMNNLLSKMLGCALVSTLLPLQFAYAQIEKDLPKNHTVSLTFHDVRDDVLKEGDRDIYAIQTKNLAQFFDWLSQSDWKPIRLKDIEEARKQGKELPHNSILLTFDDGALSSYSRVFPLLKQYQIPAVFALPTSWLNGNTQAGYEAYGQGNLVNWKQVREMQASGLAEFASHSDDLHHGVLANPQGNEQPAATSYAYLKSQKRYETDAEYQQRILQDLKKSYAVLKKEVGVEPKAIIWPYGAVNEQLEKLSQEAGFIFSFSLGRDGMNRVSDSTFKRSLVTNNPTAEQLTEGMINILNFEELDLFKQPRHFVSMDLEQLTASTNTQSDEKLGLLLSKLYSLKNNTLILKPLDDQDGDGQYDIAYFPTTQLSVQQDILNRTLWQAQTRAGQSVILELPVYPQKNKPFLVADLAKDIARFNSNLSGIQLNAGTTLNCAMQSTTIKENTCADQLKQLTYVSQLTQKAVKPYLNMSNQAQFSLLLTPDFEHIENLPTLLKNLLSQHDLVNLKFNIVGKQKQFNHVLALLNTLDTKYKQRIMLTLSLPENNQQNVWQEVKQGLFNIQRIGIQKFGIDGYTNENSKNVHEYLYNPISLNSSSVMYQPFAGLATEGKK

SEQ ID NO: 6933 - protein, 95 aa, Acinetobacter baumannii
VFQSEQEELTMELKAYLHRLENIKAIHDLHAAGLDHHVIAVFLSAEGISMTAQEVTTIVNTYDALGKVKLPSKKVQALINAKKLGQNDETLPCPV

SEQ ID NO: 6934 - protein, 61 aa, Acinetobacter baumannii
KNKSGLKPYKSVCPPHFYNRWKISATAFWGGFLLPYTYLNNYIIKNSITYLYSMLSFSTHL

SEQ ID NO: 6935 - protein, 316 aa, Acinetobacter baumannii
FYMSNQLPVINLMGPTASGKTALACELYERGNFELISVDSALVYKDMDIGTAKPTREEQELYPHHLIDIITPLEVYSAAQFVEDACALIDEMHSRGKTPILVGGTMLYFKALLEGLSSNLPSADANVRAAIEEKAANEGWQAVYDELVAVDPAAGVKFKVSDKQRIIRALEVYRITGQPITKLQAEQPKNVPYRYTFHNYALLPDRLELHQRIEQRLSKMWDIGFLSEVESLIEKYDLDENLPSMRSVGYRQALEFLLKSDMSLKKKQEMEDKALFATRQLAKRQYTWLRSLQEIHDFKTYLTIKQAKEDLRNSYG

SEQ ID NO: 6936 - protein, 162 aa, Acinetobacter baumannii
PRLPWRSFMKNDANIDVEVLDIPEYIDQPEYVKNKTANYTLQTIGWFCLMWLLFPLVSLFLWIFEGHLIYDYVWVDHVSEVKTLLHLLLLIGLSALILILWASYNWLRFHGDDRGSKAPNSSVELLASQFMVSTESLSELQKSQRIILHYDEQGYLTRYDLK

SEQ ID NO: 6937 - protein, 567 aa, Acinetobacter baumannii
IMIPLIPVNKRTMSMSENKTTSETSDHHETDVELENMNDLPEPQEKKNRWKPLLIWIIPLIALLIALSLAVKALLSNGPTIEVSFRTAEGLVAGKTTVRYKQVDIGVVRQIDLAEDRSHIIARIDLRKDASNFAAQDSRFWVVRPRIGTSGVSGIDTLLSGSYIEVDGGKSPEKKLEFTGLEIPPVITSDVPGKEFFLKADDLGSLDIGSPIYYRRINVGQITAYKLSDDGKSVELQTFIRAPYDKFVTTDTRFWQASGIDVTLNASGFNLDTQSLASIVAGGIAFGFPENSNATVAANKSRFNLWDSKAEALKEPDGLPRGVIMYFDHSLRGLAVGAPIDFMGIEIGSIKSINAEFYNNYKQIRMRVEAVIYPSRVENGQALNPNSDIFKDFVEHGWRAQMRTGNLLTGQNYIALDKFPKAKPATLQILNDGRVVIPTTATELSGLQAQVSQIADKLTKFPLVEIGQDVRKTLKNMNTAIESTDKLVKQLDGKVAPSLQATLDDVRKTVRSSESILSSDAPLQQDVRKALQQMTRAAASLQLMADYIEQHPESIIRGKRPEANDEK

SEQ ID NO: 6938 - protein, 227 aa, Acinetobacter baumannii
SLTPHKEEVLKIHGSLKRYILNGWLKRKFMVLLNSSAHHIYWLGRYLMRIQFAVSHLPFTDDAKAAQFAAAFGLVIDQAELLNCYMLDTKQTYSLLNQFAIAKDNIQELRGILSSNAYAELNHAIKGVQAHPDSLKQALAKCNQILDAEHEDIALFLHLGQKIELFDIQLRFQQDLTQLLQELEQLLQQLNDLGWNKLTQPWQLLKDHPNWEAYYNFTQQLEYMFEA

SEQ ID NO: 6939 - protein, 76 aa, Acinetobacter baumannii
HLKPLRLSFACWPTLPVGFSRPLAKEHEKVITFFVGIPACPLCGGTGGGHLRVCWILWLQSANPLSFRHHYLAVMW

SEQ ID NO: 6940 - protein, 501 aa, Acinetobacter baumannii
LRMPLDGKSITKKPYYFSSKILAKGINEFSVDVGVPRYNYGLYSNDYDDATFASGAIRYGYSNSLTLSGGVEASTDGLSNIGTGFAKNLFGIGVINADIAASQYKDENGYSALLGLEGRISKNISFNTSYRKIFDNYFDLARVSQVRYLKDNQSDAESQNYLNYSALADEIFRAGINYNFYAGYGAYLGYNQIKYSDNQYKLLSANLSGSLNKNWGFYTSAYKDYENHKDYGIYFALRYTPSNKFNAITSVSSDSGRLSYRQEIFGLSDPQIGSFGWGGYVERDQDNHDNNASIYASYRARAAYLAGRYNRIGDNDQVALSATGSLVAAAGRLFAANEIGDGYAVVTNAGPQSQILNGGVNLGFTDKSGRFLIPSLMPYQENHIYLDPSFLPLNWSVNSTEQKTVVGYRQGTMIDFGAHQVISGLVKLVDKNNSPLLPGYSVQINGQQDGVVGYDGEVFISNLLKQNKLVVDLLDHGSCQVDFTYNSNQYSTKKLGPYVCH

SEQ ID NO: 6941 - protein, 78 aa, Acinetobacter baumannii
LTQPLLDQLQQLHESQYLLKSRYSFVGHFAHQYNEFYNAFFYPETKSKSSIYGLILIITEITLSNLSNKMLYKLDSLK

SEQ ID NO: 6942 - protein, 68 aa, Acinetobacter baumannii
VVKLPKIVTMMTVMTVVMIVMTVDIMMVIAAITEVVTTVMTTVYTVVGTNIVNLYINLKKHPSGAFLF

SEQ ID NO: 6943 - protein, 443 aa, Acinetobacter baumannii
LYFTISIWDYSILKMLKKCVFSLVYLLPIQLYAAQVDVLREQAIQNYRAGQTQQAVSQLDQLLNKYPHDQKLLADYLFIMSSEKRDLTNFSRFLVNINYVDFPEYAKLPLIQNFRDFKHFKTAIDWSNKFNIQKSVDGRILLSVLYAEAQDVANAKDQLSKIDIKGLTADQLVRVAYAYRLINLPVDALATVEHAYQQQPKSSSVLQEYVYDLIAIGSYKKAQQLLQASEKTEQTVQMLQTLQVSEFSQHINNAIARYKYLNREGLADAESFAELDKVLEQGQKIHQQMNPSDPNYLRFYYDYLYGLDFRGRSKAVIENFTQLNIPLEKLPAYVRHAIADSYLAGQKPKKAEFAYKTLLTEKNYPDMTVYTGLYYSYIEQEKYKEAEQLLAEVDRLIPTYKYSQAKGVDKISHPDRDDYIALQGMHLAYANHLDQAEKHFQKK

SEQ ID NO: 6944 - protein, 216 aa, Acinetobacter baumannii
KYFTQTPCLVIYIKTIKIIINENQKDFWKMSIDLKNNVAKSAIFQNTVEDFEAFTGQILPSNKLKEFDFSHLNVAIIGTDQETVTHLEKICQQAKFVTVFQITPHFILPHSQIGIHRLITHPLIAKNRRLFNNRVKSILALRFLETQVNETWLKRLLTPNTARANKIFFKSDSYYTALQRANCKLQTWPIVKVIDTAIYSMDGTQRPVDIIIRTTP

SEQ ID NO: 6945 - protein, 147 aa, Acinetobacter baumannii
IVLTGWIMIKIDTFDTMQIKKSFTTLKGQERIKQILKNAEIVFLTKGYSGFSMRGVATQSNISLSTLQHYFQNKDILLKALLNKLICDYIQRIEILINLNANEPPLIRFMNIITNIIYEIEGEFKHEVRQFQKPYDNQQAEQISLMV

SEQ ID NO: 6946 - protein, 456 aa, Acinetobacter baumannii
KMLTRFLLPILGTTVLVTGCASSSQYPINESYGPEPKLPEPKTSLFPTVNIAPAQGWPSGVMPTPAEGLKVKAFAKGLEHPRWLYVLPNGDVLVAETDAPPKPEDSKGIKGKIMTFVMRRAGSSHPSANRISLLRDTNGDGIADQKTVFLKNLKSPFGMALVGNHLYVANTDSLMRFPYQEGETHITSTGTKVLDLPGGPLNHHWTKNVIANREGTKLYITVGSNSNVAENGLDQEKGRAQIMEFDIASGQSRPFATGLRNPNGMAWQPQSGKLWTVVNERDEIGSDLVPDYMTSVQDGAFYGWPYSYYGQHVDVRVKPQNPDMVARAIKPDYALGNHTASLGLAFYTAELMPQFRGGAFIGQHGSWNRKPHSGYKVIFVPFRSGQPSGPPQDILTGFLSEKGKAYGRPVGVAIDFSGAVLVADDVGNTIWRVSPVAETTYESPTQQSIRSSVTQP

SEQ ID NO: 6947 - protein, 147 aa, Acinetobacter baumannii
MKELGKKEFFFSIEKYEPKNDLFLLVVNINGTSFSNYETPINLPILINDLNLLLYTNQREIDYLQVDTVNENIELIKKLINLEYLELENNIYDFQNSTVRNGHEVFFFFKIPNHSFYESPSLIKAGEGYVETIPIQTVKFALNELIK

SEQ ID NO: 6948 - protein, 259 aa, Acinetobacter baumannii
CLWFKCWLVECKENEMTYCCALRLEQGLVFISDTRTNAGVDHISVFRKLHTFGVTGERFIALQTAGNLATTQAVIGHLQNALILQQEPNLYSINTMFEVADLVGKTLKSVLEDISSDTQEQMNYACSILVGGQIKGGDMQLYNVYPQGNFICATTDTPYFQIGESKYGKPILDRALYYAMPLDDALRCSLISFDSTLRSNVSVGLPLDALVYSKDSFVIPMGKRITEDDPYFSQISRQWSDTLRRGLQEMPKPTDDYWR

SEQ ID NO: 6949 - protein, 480 aa, Acinetobacter baumannii
PPRFFIMSTLIYPNLNLKDPHFKAFKISDDFIPQTQSHTFNSELFLKEVDEYLSLYPHTQHIDICLHDLNGHIRGKRIDVKSLKNLSNGCYFPLSVYAMSLDGKVIEETGLGKYIGEPDRLCLPILGSLQPSALSPELNAQLYLSMQEEDGSGCRYEPRNILKKLLNQLHANNYFPVMAAELEFYLFSPQHQSEICSENQCFDIDAPNNYQQVLDEVEKAALLQSIEITAIVAESSPGQYELNLQHNHDILKLCDQINALKRIVKQVARKHDLTACFMAKPNLAKAGSGMHFHMSLLNQYHQNIFSSEEEKDELATKLLSAISGLIELMPASMAILAPNINSYRRFKIGHHVPLEANWDTNNRNVAIRIPCSDVQNQRLEYRVAGADCNPYLVTATILAGASYGLSHKLPLPKPAHLLKFPDEHILLANNQPEALKIFKGSLILKGYLGADFVEHWYTVKQAEYQNIYSQMTEAEQHWDI

SEQ ID NO: 6950 - protein, 99 aa, Acinetobacter baumannii
ATVTIDVVAINALASQTFIFIVELHALFNNEQSLCLELNVIKNFEKIMKKAHADTIVLCLLCIVSINMWINYEQLSWKPKFLVIKKHPKVFLSRFHHGN

SEQ ID NO: 6951 - protein, 465 aa, Acinetobacter baumannii
KDVTMSYRNIVANQQYHFADLKTLMAKATPLRSGDELAGVAARDATEHVAAQMTLADVPLKTFLNEVVIDYETDEITRLIIDEHDLAAFAPISHFTVGDFRNWLLGEDATPESLKALASGLTPEMVAAVSKIMRNQDLIYVASKCEVVTQFRNTIGLKGHLSTRLQPNHPTDDVLGISASILDGLMYGNGDAVIGINPATDNLHNLSELLKLLDHVIQEYQIPTQSCVLTHISSGIQLAEKNVPIDLMFQSIAGTQLANEGFGISLDLLQEGYEATLSLKRGTIGQNVMYFETGQGSALSSNAHHGVDQQTLETRAYAVARKYNPLLVNTVVGFIGPEYLFNGKQIIRAGLEDHFCGKLLGVPMGCDICYTNHADADQNDMDVLLTLFGAAGINFIMGIPGSDDVMLNYQTTSFHDALYLRQLLGLKPAPEFSAWLEQQGIFKQHNSQICWADHMPDQFSRLLMN

SEQ ID NO: 6952 - protein, 243 aa, Acinetobacter baumannii
IMKTIGLLGGMSWESTALYYQQINRMVQNKLGKLHSAKIILNSVDFEEIAALQAKGLWQEAGAYLAEQAQNLEKAGADCILVCTNTMHKVAPQIEDAITVPFIHIADATAKEILSQNIRKVALLGTAFTMEQDFYKARLQDRGIEVIIPNDANRKIVHSIIYDELCLGVINPDSQIKYTTIVEELIGQGAEGIILGCTEICMLIGDIKFSVPLFDTTTIHAKEAVNFALEQKTAARSIAASSV

SEQ ID NO: 6953 - protein, 157 aa, Acinetobacter baumannii
LKRTWVFYIWNLKMLKTIVEFKFDDYQLYDQNLSAEDGNTLVQKTEDIAQYIYSILKNRYHLNIELNAERWGWEIEVPLPEITMYIGISVYEEYSNGFAIFISPNTPILRRFLFRKLDITHHIMLLQNYINVILKSHAGIYDVQWWEENEFRYVAAH

SEQ ID NO: 6954 - protein, 80 aa, Acinetobacter baumannii
IRRTSMARFYRRRKFCRFTAENVAYIDYKDIDTLKQYITENGKIVPSRITGTKARYQRQLALAIKQARYLSLIPYTDNHK

SEQ ID NO: 6955 - protein, 372 aa, Acinetobacter baumannii
VFWTFEIFPLMKASLRLRLDQLCDRHEELTALLADAEVISDNKRFRKLSREHSDLTEITEVWGKYRQAEEDIETAEMMKSDPDFKDMAEEEIQANKVLLEELESQLNILMIPKDPNDSNAAYLEIRAGTGGDEAAIFSGDLFRMYSKYAESQGWRIEVLSENEGEHGGFKEVICRVDGDGVYGRLKFESGAHRVQRVPATESQGRVHTSACTVAILPEIDVDTNVEINPADLRIDTYRASGAGGQHINKTDSAVRITHIPTGTVVECQEERSQHKNKAKAMALLVSRLENAKRAAADAATSEMRRDLVGSGDRSERIRTYNYPQGRMTDHRINLTLYKLDAIMEGDLTELLDSLHREYQADQLAMLAQENGG

SEQ ID NO: 6956 - protein, 345 aa, Acinetobacter baumannii
KIGTLCMSLNFMNKAQIESYKKLPRSLKYFIGICLCYLVYAFFSPAQAACTVSGTTNSTFNYTAANINSDATVNLSGTITCTNLGLPQISNFMCMKTVFTGATTANNSVTLPYTVTATVGGAGSSTTNQTSNVWYGPVATVASNNIVSYSVNIKVPARTGSLIAYPKGTYTASVRLYWDMDLLGLSCGDLLGGWDSGDTLLTANFVVPSLCQLNSTSTVDFGNINDIGTTKRDYTAQGAVNTTCNYGTPYSIYLGDGNHRIAGGFRRMIHDNNDYIPYQLYKDSNYSTVWDATGGVTNVGGSGGVSKTGTGSAQSTPVYGKIPQGTSISTKPGNYSDSVVVTVTY

SEQ ID NO: 6957 - protein, 520 aa, Acinetobacter baumannii
DEVAMSEQEKDLQADIDYFLQEQATNALLNQTSFIENLSVQSNLFEQLKSQFFNEMLDDATSNGVASKKIEQWLSIRTLDELKQLNAEAKQHFLYHGITFNVYGDKEGVERTIPFDLIPRVIEKKQWEKIAAGCSQRVKALNYFLDDIYHGQHILKEQLIPESQIICHEAFQPHMLKYTLKGKIYSQISGIDIIRDSEGEFFVLEDNLRTPSGVSYMIECRNISQQLMPELCAANNLQGIEHYPSLLKEILQENSEIDQPFIVVLTPGRFNSAYYEHAFLAREMDVPLVTNRDLFVENDQVFVKTIRGHQKVDVIYRRLDDDFLDPLAFRPDSALGVAGLMSAYLQKNVVIANAPGTGVADDKSIYPYVDQMIQYYLGETPILKNVPTYQCREKEHLDYVLAHLDQLVIKEAQGSGGYGMLIGPKASSCEIDEFRQKLIATPHEYIAQPTLALSVAPTLTTAGVAERHIDLRPFVLSSPYRTEIVPGGLTRVAMQAGSLVVNSSQGGGIKDTWVVETLHS

SEQ ID NO: 6958 - protein, 573 aa, Acinetobacter baumannii
RRIAMLEFILVLFIAIFLAWCLSKYLSKVMANQPMWGDGLFRWIENPVYRLLGVSPQQQMNWKQYSLAFVVSCIFLAVAILAIFMTQAWLPLNPNHAPNMSWDLALHTVISFLTNTNQQHYSGQAQLSYLSQMTGIVGLQVITPMMGLALVVATLRAFFYQRPSHIAADVAEQPDQILIGNYWADVIRPTVRFLLPLCFVWSLLLNSQGVPATFQGGPEVQLMDKANSVETQKIPLGPVAPMVAIKQLGSNGGGWYGPNSSVPLENPTPLSNLLEMIAILLIPITVIFMVGHFTQRKKFAYFVFGSMLFMSIISGAAAVWSESMSSTASQLAVMEGKEQRFGPAASAVWAVLTTQVNNGSVNMMHDSSAPLTGLVELINMLINAIWGGVGCGLQQFMIYLLLAVFIAGLMTGRTPELFGRKIEAAEIKLLAIIILIQPLVILAFTALSLSVPGISGISNPGPHGISQVFYEYVSAFANNGSGFEGLGDNTIWWNVTCSIALLLGRFPTLILPLMIATRLAAKRKAPETSGSLQVETPTFALTLITIVVLLTLLQFMPVLVLGPIADQLLLVKG

SEQ ID NO: 6959 - protein, 272 aa, Acinetobacter baumannii
FYPAVGIYVRGIIMKLMVNHQTHYNYTETAKNSIQYIKMMPQTSLHQHVMNWAISVPGDKTLKRDIFNNIWITASQRYEYQHLTFMAQGIVELLNTEIGGVDVSIPINLFLQSTEATKYDAEMLDFAQRIVTVKDRQHIALLSENILQKMPYQPDSTSVHTTATQAFQAGQGVCQDHAHVLIAMCRALQLPARYVSGYLFDQNSPHLASHAWAEVFLDNQWYCFDVSNQLFTPKHHIYLAVGRDYLDVAPIRGVREKGGTENMMSVVQVLAC

SEQ ID NO: 6960 - protein, 83 aa, Acinetobacter baumannii
MATAIENRARQLKNAKRGGYAPTIAKDVNKHKVQKIRRALDEARRYVSELNDETVIFDDQDARQKAEGAKAIIEMFEAALSGA

SEQ ID NO: 6961 - protein, 414 aa, Acinetobacter baumannii
CIKAKYLLLCYSSYMNNSSSKRSRAVFQLDAASALTLNTITLMTFMAASSAPTPLYRLYQQLWQFSPVTLTLIFATYAFTLLGSLLIIGSLSDYIGRRPVIIAAISLQIISMSFFLFASDVSMLFIARGLQGIATGLAVSAIGAAILDFSKLHGSLINSIAPMIGMAVGIFLTCSILQFSAHPLQLVFEFLCFLLICELILSFLTPETAQRRSGALASLKPNMAIPPQTKSALLSISPINIALWMVSGFFLSLMPSLLAKIFHTSSAWLNGIMFMALALSGAVGILTLRKSTNFRILLTGTLSIAIGAIVLFIAINLTNAVVLFLGSIITGVGFGTAFMGAIRSVMPLALPEERAGLMAAFFVESYLAFSIPAILAGYFVGKIGLMSTANSYISFIILLSLVALLMIIKNFKNK

SEQ ID NO: 6962 - protein, 401 aa, Acinetobacter baumannii
FIMASPQSPSSSPRHYSLFLAIFSLAVGGFCIGTTEFVAMGLIQEIAHNLKITVPEAGHFISAYALGVVIGAPIIAILGAKVPRKTLLLCLMLFYGIANACTALAHTPETVLVSRFIAGLPHGAYFGVGALVAAELAGPSRRASAVAQMMMGLTVATVIGVPLATWLGQHFGWRAGFEFSATIAFFTLIAVACFVPNIPVQATASIKTELAGLKNINMWLTLAVGAIGFGGMFSVYSYVSPILTEYTKVNIQIVPIALALWGIGMVIGGLAAGWLADKNLNKTIVGVLISSAIAFVVASFLMSNIYSAIGSLFLIGLTVMGLGGALQTRLMDVAGDAQTLAASLNHSAFNLANALGAFLGGWVLSHQMGWIAPIWVGFVLSLGGLIILLIAFAVEKATQKA

SEQ ID NO: 6963 - protein, 123 aa, Acinetobacter baumannii
IEVAMPHVVVDYSDNLTGLNAKQLLEEINTTLIETELFSPEDIKSRARRDEVFLIGLGVDQAYIHVKAYILSGRTAEQKQLVGEQLLAALSNKKYLPQEFNKEIQLCVELIDMPRDDYFKQVV

SEQ ID NO: 6964 - protein, 177 aa, Acinetobacter baumannii
FKNFFLELKMSKGQTLQDPFLNSLRKERIPVSIFLVNGIKLQGHIESFDQYVVLLKNTVSQMVYKHAISTVVPARNPRPAGAQGAGFPAQGGSQGGFGGQGAGFGGAQGAGFGGQGGFGGQGGFGGQGGFGGQGGFGGQGGFGGQGGFGGQGGFGGHQGGFDNDSKFEDGQDDENNR

SEQ ID NO: 6965 - protein, 74 aa, Acinetobacter baumannii
IKLYANRKRINFLIRNKKPVATSKSGEVLCYRFYYLMIKKYNLKTIYSLIVIKESHYKNFTNFRIELLFKKQNF

SEQ ID NO: 6966 - protein, 81 aa, Acinetobacter baumannii
SSPYFLYFMFVYVFGNGWRISSTFSVFKLSSSVLNCCSHSNTPTHLTNLSKATLLFVILKHLVFSLFKVSNLLLKPYSCKF

SEQ ID NO: 6967 - protein, 213 aa, Acinetobacter baumannii
LCNYLVCNLEFEMKTYVQNSEANLGQTLRASLGLLIFTLVGCGAAYSAIATGAGQVLFNNQVNGSLIEIEHKVLGSKLVAQPFVGEAYFHPRPSAVAYDPMAMAGTNLARTNPELQQQIDAQILAVKKQDHTGNNPIPSDLVTKSGSGIDPHISPESAQLQVARVAQARHLDPKIVEELLQKYVEPKQFGVLGQARVNVLQLNIALDQLQSTH

SEQ ID NO: 6968 - protein, 502 aa, Acinetobacter baumannii
DSILRLDMRTSEKQVKPIEIDDINIIENEKTKKAITAAALGNAIEWFDFGVYGYVAYVLGKVFFPDASPSVQMIAALATFSVPFIFRPLGGLFFGHLGDKYGRQKVLAITVIIMSISTFGIGLIPSYETIGLWAPILLLIVKIVQGFSIGGEYSGAAIFVAEYSPDRKRGFMGSWLDFGSIAGFVLGAATVALITHAVGEARFAEWGWRIPFFLALPLGIIGLYLRNRLEETPVYQQHSEQQAQKSKPQKFSFKEIFVKHKRSLLVCIGLVISTNVTYYMLLTYLPSYFSHNLGYSEAHGALIIIAVMVGMLFVQPVIGYLSDKFGRRPFIFIGSFSLIFLSYPAFVLLNSGVNYQIFIGLLILALSLNMSIGVMASTLPALFPTEIRYSALGIAFNFSVVIAGLTPTLTATLVETTHNLMVPAYYLMICGVVGIATAMYLKETANKPLIGGVPIAHNIEEAQELLEEFHETIEQKIENIDQKIQELQQKRQKLADKHPDIA

SEQ ID NO: 6969 - protein, 202 aa, Acinetobacter baumannii
RHVYLFYIQQKIILNGITMPNLEASFRALRVLHTARDLFKQYGFHKVGVDRIIAESKITKATFYNYFHSKERLIEMCLTFQKDGLKEEVFSIIYSYRELMVFDKLKKIFFLHANLEGLYRLPLQAIFEIEKFYPTAYKVVVDYRNWLVNQIHQLLLTIKATATLEDAYMFLFVIDGAMVQLLSKDRIDERDKLLDYFLVMMS

SEQ ID NO: 6970 - protein, 61 aa, Acinetobacter baumannii
FVLYIKQISHILFVEFDSFCSTNLIIIYVGYEYEKHSEITSCSINSCWLCGKYSSSCYWTG

SEQ ID NO: 6971 - protein, 576 aa, Acinetobacter baumannii
RCTYEIMKQETALKLLKAGENVFLTGSAGAGKTYTLNQYIHYLKARKVPVAITASTGIAATHMNGMTIHTWAGIGIKDQLTDDDLKRMKERKYLKEHLENAQVLVIDEISMLHAKQLNLVNQVLKYFKESDEAFGGIQVIVAGDFFQLPPVGRNGEANRDKFCFMSDAWVEAKFRVCYLTEQHRQDDEILNQILNAIRAQSIQTEHLQALHQSRTHDIGETFTRLYTHNMDVDNINYQHLNEIDNEGHQFNAVLDGNEKLLETLKSSVRAPEELTLKKHAKVMFVKNNFDMGYINGSLGEVIGFEEDDENGLLPKVKLTDGTTLLVAPETWSIENEAGKVIASFQQIPLRLAWAITIHKSQGMTLEAAEINLMHTFEKGQGYVALSRLKSLTGLKLLGFNEQALELDSLAVKADRRFQELSKEAEDNFANVDLTAQHKAFIRHCGGTLNETEISRNEKKLARGEKQNYASATLDETRALFEEGYEIEDIAHERGLTPATIINHLARLHKEQKLDISVAHPGEEVVEEVRKIYKKLKKRQNPDHFSDDGSIKLRPIVEATSPRMGYDQVRLALLFIE

SEQ ID NO: 6972 - protein, 65 aa, Acinetobacter baumannii
KNKYFFSPYLLFVIKVASYLIIVMYVTFLTILYHLDMGLFDSQNAKEMCFFIGLSLANSIIRCSG

SEQ ID NO: 6973 - protein, 405 aa, Acinetobacter baumannii
KCEYIRNLQMFTKKDLLQQRMLIDQLRTQNSLSPQNAAKLGQSIASSWERSASAAIPKERFAAPLLERKSASQNALDLALSQCADDLRHIAEQSSMVIAVGDIGSTIIWTASSAQMQSAAERVHFVQGGQWREEFVGTNALALSLKTQQSSCVFSNEHYMESIHDWVCYAAPIIDPYSKQTLGVVDLSTTWKNHNTLGILAAERCASIIQSALLEQQRQHLHIRAFSTPQVKFNGKSLLLTPRQIEILTILALCPHGLTLEHLYQALYGERKVSMGTLKAEMSQLRDILGGLLGSRPYRLLVHVEADFLQAEQALDAGYVASALQLYTGVFLAKTESPFLCAWRDCLESRLSDAIFKTQETDLLLKHLAHFPEAIDAVERLMELLPSEHPAHQLLVKYIDSPKLS

SEQ ID NO: 6974 - protein, 71 aa, Acinetobacter baumannii
INKYGIGGKILITSHCFSLYLYKKRFLFLKNATYEQVLRLLKCIKLIKTLNSLRRSFVIYVYLRATNTSII

SEQ ID NO: 6975 - protein, 286 aa, Acinetobacter baumannii
LSYLWLNKDYQMTSTSNLIEQVIEAWQNMQAKTPLVQCITNSVAANYTANVLLASGASPAMIDNPYEAESFTKISSALSINLGTPTSEQMQAMQISAKTAQLNEIPWVLDPVGYGPILAWRSQMTDELLQFKPSVIRGNASEISTLAGNQVQSKGVDSTLSSDKAYQQAFSLLTHASCIAISGESDYILSNEVDAVIQVNGGSPLQPKITATGCALGALIAAYSAVTTPTIAALSAHIHFAIAGKLAANQAQTMGSFSSIFMDYIHMLDANLIEQYADIKLLDKQA

SEQ ID NO: 6976 - protein, 412 aa, Acinetobacter baumannii
VLDFFNFYRDLQAELSNYPWLEMLVSLTLLILFAALANFIAKRIIVRGIRHLVTKIKSLNQSVFAQHSVIKRFANIVPAIVIMNGITTVPHLSEKAVALVQMGAQAFIFLTIALTISELLNIFNLIYQRNPKSRNKPIKGYLQLVKLIIFVVCGLMILGTFLKKDVFTLLAGFGAMAAVLMLVFQNTILSLVASVQIASYDMVRIGDWIEMPSLNADGDVIDISLHTVTVQNFDKTYTTIPTNKLVTDTFKNWRGMSNAGCRRMKRSLYIDQTSVHFMTEEEQQKLKDFLLLDQYLNAKQSEIDEFNKHLGSQSRYNKRRLTNIGTFRAYVEFYLRQHKGIAQNQTLIVRQLQPTSEGLPLEIYAFTNTTAWVSYEAIQSDIFDHLIAILPEFGLRVYQAPSGHDFQKLTVE

SEQ ID NO: 6977 - protein, 218 aa, Acinetobacter baumannii
SMDLLNTVKSRYTTKAYDPEKKIPQEKFNKLLEILRFTPSSVNIQPWHFLVADNPTAKERIAKALTGRYAYNAPKVLESSHTLVFCTRTDISPEYLNQLLEQDDLSGRFKDEKAKLGQKDTRHGYVEFYRNEQKNLFGWMENQTFIALGQLLFAAGLEGIDATPMGGFDENVLNEEFGLKEKGLRSSVIVSLGYRSENDFNAKLPKSRLPDEVIFTHL

SEQ ID NO: 6978 - protein, 433 aa, Acinetobacter baumannii
IMDFNTLDQETVQKKQKFHQILYVQVIFAIILGILIGHFYPELGESLKPLGDAFIKIVKMIIAPVIFLTVVTGIASMTNMSRVGRVTGKAMLYFLTFSSLALVVGMIVANIIQPGKGLNIDPATLVNDKVNSYVEKAHATNITDFFMNIIPQTLVSPLAGGEILQVLFVAVLFGISLAALGDRARPITDFLNNLTAPVFYLVGMLMKLAPIGAFGAMAFTIGAYGIESIGNLLLLIMTFYITAVLFVLIILGAVARYNGFSIIDLIRYIKDELWLVLGTSSSEAALPSLMDKMQKAGCEKSVVGLVIPTGYSFNLDGTNIYMTMAALFIAQACNVDLSIGEQVALLLVAMVSSKGAAGVTGAGFITLAATLSVVPAVPVAGMALILGIDRFMSECRALTNLIGNACATIVVARWDKALDKDVLDKALRKSKTN

SEQ ID NO: 6979 - protein, 222 aa, Acinetobacter baumannii
RFIQRYEHYPKGELKKELLSRLVHENKKRKAYVEPKKDFILQDIKTIHERPAEVQERKIPGHWEADLIKGKDNKSSIATLIERNTRLCILATLPDAKAESVRKALTEALKYLPAELRKTLTYDRGREMSEHKILEEDLGIDVYFCDPHSPWQKGTCENMNGLIRQYLPKGIDLNQADQHYLNQVAMSLNTRPRKALDWLTPLEKFAQLVDYHMAFETVAPHV

SEQ ID NO: 6980 - protein, 337 aa, Acinetobacter baumannii
KDDLLFHFGFIFIMSLKSKFSLPKTLLASTLGFVFASSTFAAIPTTLKLDYAYYAPTSLVVKDQKLLEKVLPNTQIKWVFSQGSNRSLEYLNSNSIDFASTAGLAAVLSRANGSPIKTVYVQSQPEWTALVVAKNSPIKSLKDLKGKKIAATKGTDPFLFTLQALETVGLSKRDVQLVHLQHPDGKTALERGQVDAWAGLDPLMASAQIQSGAKLLYRNVAFNSYSVLSVKEDFAKQSPEAVEAVIKAYEQARKWAKANPDKVAALLAQESKLPLPVAKLQLSRTNFDQSIPSATQAQALKRSGKILTEEDLVRKGTNVNQVVDQLLDPRFAQKVVK

SEQ ID NO: 6981 - protein, 417 aa, Acinetobacter baumannii
STHHNTKAMVRLTCNNKQWIYGKRNHSMTFKNIADQTNGFYIPCVSLFGPGCAKEIGTKAQNLGAKKALIVTDEGLFKFGVADLIASYLTEAGVASHIFPGAEPNPTDINVHNGVNAYNENGCDFIVSLGGGSSHDCAKGIGLVTAGGGHIRDYEGIDKSKVPMTPLIAVNTTAGTASEMTRFCIITNTDTHVKMAIVDWRCTPLIAIDDPKLMIAKPAGLTAATGMDALTHAVEAYVSTAANPITDACAEKAITMISQWLQPAVANGENIEARDAMSYAQYLAGMAFNNASLGYVHAMAHQLGGFYNLPHGVCNAILLPHVCEFNLIACPDRYAKIAELMGVNTHGLTVTEAAYAAIDAIRKLSSSIGIPSGLTELGVKTEDLAVMAENAQKDACMLTNPRKANHAQVVEIFKAAL

SEQ ID NO: 6982 - protein, 212 aa, Acinetobacter baumannii
FMRHYTGIDQLINSFDQALRSLVPGATAAQRQNPAETVEAKLGVEDARHVAGLMRVNHSGEVCAQALYHGQALTAKLPNVRREMQQAAIEEQDHLAWCEDRLKELNSHTSLLNPIWYGLSYGMGALAGIAGDKYSLGFVAETERQVSLHLQDHLNQLPAQDERSRKILEQMNEDELHHRHTALEAGGVELPYAVKITMTAISKLMTKTSYYL

SEQ ID NO: 6983 - protein, 665 aa, Acinetobacter baumannii
LYQQSICTRLCRNSFMTDEKLTQRRIHTLDAALANQIAAGEVIERPSSVVKELLENSIDAGATELIVRIAQGGSTLIEIIDNGHGIHPDDLPLAVMRHATSKIKTAEDLHAIVSLGFRGEALASIAAVSRLTLTSSQDESGIGHQVEVNGTAFDHQQVQAVAAQKGTHIRVQDLFFNVPARRKFLKKPTTEFGHIEEIVRRLALTHFDIRFVLEHNDNIRINLPIADSGELRFQRVQQLLGQQFVQNAYWIDAESINMRLSGWLGHPSDARAQADLQYVYVNGRIVKDKTISHALRMAYDGILHGHQHSSYLLFLEVDPENIDVNVHPTKHEIRFLNQREVHEFVRHYAKETLAQFQTASADLAQAMKADDTQASFVQSQPKYQEQFTLHRTDQAVDTTLDKSSSYQPSTELLTDFNNSRPQAVHYAEQTPKYNGSAQLNNALKTYLAPLRDQPTNFSVDENIESVAKVDEFPLGIAIAQLHGIYILAQNTEGLIIVDMHAAHERILLQQMKNAWDKPEFWTSQQLLIPKVISISRMQAIRVEDLKPQLERLGLEIDLYGDEQVIVRGVPAILQKADFENLIPELLNDLDPNDEAQGLLQKRDELLAGMACHGAVRAHRQLSLSEMNALLRQMEQTEFASQCNHGRPTWRAFPLSQLDKLFARGE

SEQ ID NO: 6984 - protein, 157 aa, Acinetobacter baumannii
KYKHKYKERLMIVRRATYEDLSQLAVLFDEYRQFYGASSNLEESHHFLKQRFENKESVFFIHIKDEKITGFVLLYLGFSSVACSTYYILDDVYVTPLFRRQGSAKQLIDTAILFAKQENALRISLETQSNNHESHRLYEKMGFIRDSEFQTFHCFLK

SEQ ID NO: 6985 - protein, 886 aa, Acinetobacter baumannii
YQVQSNRENQAEALLNHVNRYQAGRLTVFLGAAPGVGKTYAMLARAKELFQQGTDVVVGIVETHGRIETLKILEGLPQISRKEMQYQGHTLEEMDLDAILLRHPEIVLVDELAHRNVPNSRHERRWQDVNELLDAGIDVFTTINIQHLESLNDVVYQITGIRVNETVPDRVFDRIRDIRLIDLPVSELIERLHQGKVYVPEQANLALQGFFSISNLTALRELAMQCVAEHVDSDLKESYASKGLKSISLQNELMIAIDGQGSSEYLVRAGCRLAERNGATWTVVNVAKSSDFGQSSANSYKKEYIEIDRAFELARQLGGRTEVLYGPRVASVLMDAAIDRGISNLVIGKSISPWWLKLFKKNLAQQLLNQENSIALTILHPEQGTKKINQLEKPSFLSLKESVFVLAVTCASIFIAHFAEVLFGIEDFSVIFIISVLIVATKTRMLAAVVAALICFLAYNFFFIAPRYTFQISAHQGVVTVVAFFAAALIAGRLASQLRQQVLSLKAANAYTTVMQDLARKLSSAVNLEEVMQTGRMTLETQLQTKVWISIRDKIISSDIELNDKEEVAAEWCLKHQQPCGRFTDTLSQSNWWFLPLLEQKNSLGIVGIYFKDEVVSLNFEQKKLTESVIEYIAQAVLRTQLVNELEQAKVTSETERLRSALLSSVSHDLRSPLASIIGAADTLANFKAEMSEQDQQDLLETIHLEGERLDRYIQNLLDMTRLGHEGLTLKRDWIGVDELIGSATRRLKRYKPDTQVSVELPEQPISLYVHPALVEQAIFNVLENAANFSPPDEPVMIRAHLSSEDEVKIEIEDRGAGIPEDERNRIFDMFYTMERGDRGKFGTGLGLTIVKAIIGAHMGTIEAFSGRQNKGTLIQIKLPLHPVKE

SEQ ID NO: 6986 - protein, 129 aa, Acinetobacter baumannii
CGQHSLCRVMMKKVLFVLMGMLIVGCTEKKPLTPEEQWHGYCTSVGNAARSILFDRQQAIEKSQAIEHANKIEDEITKKFIFNIIEKVYAIPQDELKTNPEALQEKIRKQMTDECLVTPHDKMPNYKKF

SEQ ID NO: 6987 - protein, 176 aa, Acinetobacter baumannii
ALKQGNGIISIILNHVMCVMSYSLKMVLNHEEDTQRLAQALAQHVQAGVIYLIGDLGAGKTTLTRYFLQALGHKGSVKSPTYTLVEPYKINNKEIFHFDLYRLNDPYELELMGIRDYLDIQDALFLFEWPSKGGDEIPEADIVIDIQKSDDELNRFVTLTLPTEHLYQTLQEQLHD

SEQ ID NO: 6988 - protein, 78 aa, Acinetobacter baumannii
NVFKLNHVVKNYAKKKKQAKSLCLFRVAAIILLFSLREVADWLIHVNFCTTKVLFNVFFNSFSVVKLTNFLKNRVIFT

SEQ ID NO: 6989 - protein, 258 aa, Acinetobacter baumannii
RYFNSNQITPSSSKRISCKFMISSETSPVETRIVIIDDEPQIRKFLDIALRTQKYKITLCETGYKGLETLATQGADLVILDLGLPDLDGREVLQELRSWSNVPVIVLSVRADEYEKVALLDAGANDYMTKPFSVQELLARIRVILRNQPIQQEAHVYDDGYLKVDVMQRLVWIEQQPITLTRKEFQLLTLLMRYQGQLLTQPQLLKELWGPTHQEDTHYLRILVGKLRSKLGDNAIQPRYIATEPGVGLRFLAKQKNH

SEQ ID NO: 6990 - protein, 211 aa, Acinetobacter baumannii
RRTKEMAEVLHHDNHGHDGHHEHDDTDLTVFGFWTYLMSDLILFGSLFIAFAVLSSHVPPGTPSAYDLFHESLGYVLTETFALLISSVTFGFAVLASYKKNVNQVITWLFITFLFGATFIGMELYEFHHLVEEGHGPTHSAFLSSFFTLVGTHGIHVTSGLVWMLVLMYQIKTKGLTLPNTRRLACLSLFWHFLDIVWICVFSVVYLLGVL

SEQ ID NO: 6991 - protein, 641 aa, Acinetobacter baumannii
FCYNVPSFFSGVFVLMHYPKVYDVIVIGGGHAGTEAALAAARMGRQTLLLTHNIETLGQMSCNPAIGGIGKSHLVREIDALGGAMALAADKGGIQFRILNSRKGAAVRATRAQADRVRYKAAIRETLENQANLDIFQQAADDLIVEGDTVKGVVTQMGIRFDAKTVVLTTGTFLGGVIHVGLEKSSGGRAGDPPSIALAQRLRELKLPVGRLKTGTPPRIDARSVDFSVMTPQPGDFPSPVMSFMGDVSMHPEQVNCYITHTNEKTHDIIRGGLDRSPMYTGVIEGVGPRYCPSIEDKIHRFSDKDSHQVFLEPEGLDTHELYPNGISTSLPFDVQFELVRSIRGMENAHILRPGYAIEYDYFNPQALKFTLETKAINGLYFAGQINGTTGYEEAGAQGLLAGLNAARRAWEQEEWTPKRDQAYMGVLVDDLITLGTKEPYRMFTSRAEYRLMLREDNADQRLTTIGRELGLVDDVRWAAYCEKMEAVERETSRLQHLWAAPNNPMGKKFVEMTGADLSKECSAIDLLKRPNINFGQIAELTGSEVSQQVGEQIEIAVKYEGYINRQHEDVAQLKRLEETKIPADFDYDVVSGLSREITQKLKTVRPETLAQASRIPGVTPAAVQLVMITIRKNNMTKKTA

SEQ ID NO: 6992 - protein, 181 aa, Acinetobacter baumannii
YQHKNHVYLKLTEESSLVYILNSTEYTLDRIDRKILSALRRNGRLTVAQLAEEVGLSSSPCWTRLKRLESLKIIEGYTVNVNPKAIGIHELFFIEITLERHDDEMLENFSEALADIPEVVEAHLVTGDYDYLVKVAVKDAEHYERFLRKKLYSIKGIRHTRSTFALRPLKSANTADLMLIE

SEQ ID NO: 6993 - protein, 81 aa, Acinetobacter baumannii
NKNNSNISIFYFLLKKTKKYRSNNIIDELNFFRKLLLTIKIFRIENVMDFTFLFIAVVRYGSQFQNTLIDYIGYFNTYILQ

SEQ ID NO: 6994 - protein, 248 aa, Acinetobacter baumannii
FQDKKMRYRIHYIDVQNALQNYIWILEDTETHEAVAVDPTEAELVTHFCQEHQLTLKQIWLTHWHKDHIGGVADLTANTPMAVYGPRDELSKIPGITHPLQHDDHLKFNDLKVEIIATPGHTLGHIVYFIEELNALFCGDTLFAMGCGRLFEGTAEQMYHSLNRLAALPTATKVYCTHEYTLSNAEFALSVEPENHALQERAEQVRMLRQEGKITLPSSIELELATNPFLRAESVDEFAHLRSLKDNF

SEQ ID NO: 6995 - protein, 79 aa, Acinetobacter baumannii
EAGNLDCWLFYLVQSALKFLLSGIKKRHLIFKARHLGIAFAFIHTNQLAGVLYESTRNSFRYFFKCRSLISRIFCSAPT

SEQ ID NO: 6996 - protein, 285 aa, Acinetobacter baumannii
RYCFNNDYMVICMNNSAFIKNGILKSFLFASTLSLVTPVMAQATFLIWPIYPKIEANEKATAVWLQNTGKTDAMVQIRVFKWNQDGLKDNYSEQSEIIPSPPVAKIKAGEKHMLRLTKSANLPDGKEQSYRLIVDELPIRLSDGNEQDASKVSFQMRYSIPLFAYGKGIGSGLTEESQKLNAKNALAKPVLQWSIRNNQQGQSELYLKNNGQKFARLSALKTSKTGNDISLGKAAFGYVLSNSTVKFAIDQSTAHELSKTSKIYGVDSSGIKQELIEITKMEDPS

SEQ ID NO: 6997 - protein, 514 aa, Acinetobacter baumannii
SLVLKKQRNIYMRYIDPNQPGSKVQFKSQYENFIGGEWVAPLKGEYFDNVSPVDGKAFTRIPRSSAEDIELALDAAHKAKASWNKSSPTTRSNILLKIADRLEANLEMLAVAETWDNGKAVRETLAADLPLAIDHFRYFAGCIRAQEGGISEIDEDTIAYHFHEPLGVVGQIIPWNFPILMAAWKLAPALAAGNCVVIKPAEQTPVGILLVAELIQDILPPGVLNIVNGFGAEVGRPLATSPRIAKIAFTGSTQTGQMVMQYATENIIPVTLELGGKSPNLFFEDIMDKEDDFLEKTLEGFAMFALNQGEVCTCPSRALVQGSIADQFLELAVERVKRIKTGHPLDTETMIGAQASLQQQEKILRCINTGREEGAELLLGGSGRKEVGDGFYVDPTIFKGHNSMQVFQEEIFGPVLAVTTFKDFDDAIKIANDTMYGLGAGVWSRSAHISYRAGRAIEAGRVWTNCYNIYPAHAAFGGYKKSGIGRENHKMMLDHYQQTKNLLVSYSTKPMGFF

SEQ ID NO: 6998 - protein, 80 aa, Acinetobacter baumannii
KEHKMKTTMLKILTASLICFSGVTFTHAADTSKAETQKQIRVCAKKQQGEWVSYNHNGVTFNGTCQPNENGKLQFKAPAP

SEQ ID NO: 6999 - protein, 330 aa, Acinetobacter baumannii
LNDNSSIKMNTSTAKHNYAPDILGAGYEQLTLNFPDDYEGKVVATLVRKKATQPTQKAVLYIHGFLDYFFQTEMAEQFNTHGYDFYALDLRKYGRSKLPHQIFYNVLDLNEYDAEITQALEIIGQEKHTQVLLAGHSTGGLTATLYAAHHPDHPFIKALWANSPFYDFNLSLVEKKFGIPMLSRVGKYLPKVKFPSQLNKWYTTSLHKQLKGEWDFNLDWKPTSAPTVQLSFVHAIHTAQKEIHRGVKLNIPALIMHSHQTKNPRKWGPDATQSDVILDVKDIAKFGKKIKGDVSVVSIYNGLHDLVLSAQPVREQVYQQLFQWLDQKVT

SEQ ID NO: 7000 - protein, 129 aa, Acinetobacter baumannii
YARNIMTNTFNNFVGEIMRNFLVTIFTLLVGTSIYASQESRNLLEQTQCEKAVELHGFLSRAQLDCNYHYYSEELKEAAAKCTKHDLGEKYGREVMKFGMKEFEERKKEDTQGHFCHKVLKEFPKYIKQ

SEQ ID NO: 7001 - protein, 286 aa, Acinetobacter baumannii
DKCLRRILMSESKQFKRSVFFISDGTAITAETLGHSLLAQFPNVDFDIHIMPYITTEEAAMAVVVEINKCQTRDGCLPLVFDTLVDPHVREIINTAKAVNLDVFEGLISKLEQELGTPPTTLVGQTHAVTDSEYYKARIDAVHFALDNDDGARTRHYDKADLILIGVSRSGKTPTSIYLSLQFGIRVANYPLTEEDLDDNRLPAVLREHRSKLFGLMIDAERLVAIRSERKANSRYASFSQCQMELRAIEGIYISEGIKYLNVTEMSIEEISTRILQMTGLKRRIG

SEQ ID NO: 7002 - protein, 83 aa, Acinetobacter baumannii
SNLKQMSFCVLDCNRAEHYPLPAGHITSQLLTELVQKAHNNVLFRFVRTPKSRLYGEARRGTLACAGFLLYQSVNPSSLATII

SEQ ID NO: 7003 - protein, 87 aa, Acinetobacter baumannii
CDIKIITTHEYRINLMDIIDIKIKDQFDQIHDAKAQLKKNLVEHENEPLKLSQRIEHIIVDNEVILPTTELLFESEQNEKIYRVIEE

SEQ ID NO: 7004 - protein, 116 aa, Acinetobacter baumannii
NKSLKIKNHLVLLFMRKTEVYQVRLDSQEKKQAFAVFKQLGITPAQAVRLFFKQVVLTKSIPFAIENQNINMEQLLKLRKAKASSLNQNASTLNEDDDHEDLFEELNALLGESDKT

SEQ ID NO: 7005 - protein, 407 aa, Acinetobacter baumannii
FFKKRGMNTVLEAYRQHVAERAALGVPPKPLDDAQTAQLVELLKNPPAGEEAFLVDLLENRVPAGVDQAAYVKAAFLAAIAKGEATSPLVSKERAVYLLGTMLGGYNVAPLVELLDDAELGSLAAEALKKTLLVFDAFHDVADKAKAGNANAKAVLQSWADAEWFTSRKDVPEEIKITVFKVTGETNTDDLSPAQDAWSRPDIPLHANAMLKNERDGINPEKPGEVGPLSQIKELIAKGNQVAYVGDVVGTGSSRKSATNSVLWFFGDEIAHIPNKKDGGVCLGGKIAPIFFNTMEDAGALPVEIDVSNMNMGDEVTLKIDHAAAKVTAFKNGEQIAESELKTPVLLDEVRAGGRINLIIGRGLTAKAREALGLAPSTLFRTPVQPADTGKGFTLAQKMVGRACGLP

SEQ ID NO: 7006 - protein, 235 aa, Acinetobacter baumannii
IMKKNIFIITGLFLSLSSTIYAATIRLSPVTVEILSNQSASSISLYNQSNESTDLQVRVFEWSQNNGQDQLTPTDKIAVSPPFLKLQPNDSYNLRVVRVNPTPVSGEKTYRIIIDELPKPMDSRKVSQGINVLLRSSLPVFVVNKDAITQLNWKIDNSQKTTSLNISNIGNRHALLNDLKLVDLTENKSYSIKVNTVNGYILAEQSRSYPISNFSYQPDHKYSISLTVNGKKVTL

SEQ ID NO: 7007 - protein, 176 aa, Acinetobacter baumannii
VLRKMKYLYFKAIFLLSVSQFIYAADPQLNSSFKVQAKIENGCSIDNVEQNMDFGKYSALSKNKVVTNVINSKGSWNIRCTESLPVSISIGGGENLQNNTRRMKNSSSPNYLSYKLYNSSSLSNEYIVRNKYLLPATTPTNRLANFEIYGVVDLENNNEPHVAGIYKDTVSIMITW

SEQ ID NO: 7008 - protein, 143 aa, Acinetobacter baumannii
IVRKLCIACLIGMAMLSMSGCAVFMAGNQPSKKNLNVLNPGSSRNYVIAEFGAPVLSEYRDGTRVEIYTFQQGYSKWVKVGRAFGHGVADVASIGLWEVFGTPAEAYFNGKETTYEVTYGEDDLVKSYKLIDFNQAFPKVKEQ

SEQ ID NO: 7009 - protein, 373 aa, Acinetobacter baumannii
KSTLVVLFYFRKKAISKKNDIHWLLYIVLFRYNVFREYRMRSLQDTKFSILELAPIRDDKTIEFSLRHALELAQHAEKLGYDRFWLAEHHNMDGIASSATAVLLGFIAAHTQRIRLGSGGIMLPNHAPLVVAEQFGTLATLYPDRIELGLGRALGTDQVTMRALRRGHQETEDQFPRDVVEILQYFKAPQVGQKIIATPGQNTHVPVWLLGSSLFSAQLAAKLGLPYSFASHFAPRMLGQAIELYRENFEPSEYLDKPYVSMGVPVVVASTDEEAQFLATSAYQRVLGLIRGESLKLKPPVTSMQGLWNTAEQLSVENFYTMAQIGSVETVRSGLQKLLDTYEVDEFIFTCDVYDTAKRLDSFTQLMQVKSGN

SEQ ID NO: 7010 - protein, 313 aa, Acinetobacter baumannii
YTMKPNDVVSNLPNNPTPNTHASVDSAQQEQQAGLDFVRQVITDDLAAGRAKQIVTRFPPEPNGYLHIGHVKAICLNFGVAEEFNGLCNLRFDDTNPDAEEQEYVDGIANDVKWLGFSWNGEPRYASGYFDQLYAWAIQLIEQGDAYVDLQSPEEIKLNRGSFVEPGKNSPYRDASVEENLARFEKMRNGELKEGEAVLRAKIDMASPNVHMRDPILYRVLHSEHHQTGDKWKIYPMYDYAHPLSDAIEGITHSLCTLEFQDHRPFYDWIVEKVKSKAVPHQYESSRLNVDYTITSKRKLRKLVEGRLCEWMG

SEQ ID NO: 7011 - protein, 434 aa, Acinetobacter baumannii
RNMKKNILFDGLRSVARIGETAVVAAKAGIKYATDKPSNAKLMRETFESLGSTYIKLGQFIASTPSLFPREYVEEFQGCLDQTPTLPFSYIQGVLASEFEGRDLSQIFSYIDETPLASASIAQVHAAKLTTGEDVVIKVQKPGVETILYTDLNVVHWAAKLLERAVPKIKFAALSEIVDEIKTRMVREVDFIEEAQNLDDFVEYLNISQNQAATAPKVYHQFSTRRVLTMQRLYGVPLTDFSVVKQYAKDPSQVLITAMNTWFGSLMLCKSFHADLHAGNLMLLEDGRIGFIDFGIVGQLKPEVWTACIAFMDALQKTDYQAMAENMLKMGMTHNKIDVQVLAQDLERLFNGVLMADPQQILASNPADLNDIMMDMVAVGERHGIKFPRDFALLFKQMLYFDRFMRVLAPYTDIYADQRLKMVQNMEPASLLKH

SEQ ID NO: 7012 - protein, 66 aa, Acinetobacter baumannii
SSKKLQKCSKPTQANLNKGKYLEFPFILYIKDRLSLPHQLNKMCHQQYSADYEVLLVHPENANAHL

SEQ ID NO: 7013 - protein, 276 aa, Acinetobacter baumannii
TRENTMKLNRDIQYPSSTHQDQWEKLKQFTDARIALGRAGCSIPTRALLEFQLSHAQAKDAVYQEMDVSYLSKQLAQQQLQSFHIQSNASNKEIYLKRPDLGRQLSNPSKDTLIKKYAENPQQYDVCIVVGDGLSARAIEANAIAFIAALSEQIQQENWSLAPIVLATGSRVALGDEVAEIFKASMLVMLIGERPGLSSPDSMGIYYTWNAYSGCLDSKRNCISNVRSAGLSIPVAVQRLMALMRKSKQLGFSGVNLKDEHQLSNIDHNENAKLLF

SEQ ID NO: 7014 - protein, 100 aa, Acinetobacter baumannii
KLRKGLNMKCSYQDLDGNIVELTCESYIHIPSGASGNKLGIDNRAEDLIHITEDFSFFKKTEADSIPLYRFAVDANYNVFNSDELPALAQIGTDWKVLNE

SEQ ID NO: 7015 - protein, 60 aa, Acinetobacter baumannii
YARNIKTVCLICNIFKSHGVIPFSINPLFVITGEPHHGLSIVMCRLFSYLPKTYQIPTWY

SEQ ID NO: 7016 - protein, 494 aa, Acinetobacter baumannii
ALLLHSFIQTNSQEYCMNQPETASVISSSAEVSSAEYFAQRQLKQGTVGWLLLIGLGVAYVISGDFAGWNFGIAQGGWGGMFIATALAALMYLCLCLSMSEMSTMMPTAGGGYSFARAAFGPFGGYLTGTAILIEYAIAPAAIAVFIGGYCESLFGINGWMIYLACYAIFMGIHLKGAGEALKIMFAITLVAVVALVVFIGAMIPHFNAQNLFDIPVSTGVGASLFLPHGYLGIWAAVPFAIWFFLAVEGIPLAAEEAKDPAKSLPRGLIGAMLILTAFAMLILFLGAGAAGASTLQNSGAPLVDSLVKVYGTNTWLATFVNFVGLAGLIASFFSIIYAYSRQIFALSRAGYLPTSLSLTNKNKAPYLAIIIPGIIGFLLSLTKEGDSLILIAVFGATISYVLILLSHIKLRLSKPDMPRPYKTPGGIITSSIALVLAVAAVVAGFVVNPKVWFIAAGIYVVFIAYFLFYSRYHLVKGTPEEEFANIKAAEQEL

SEQ ID NO: 7017 - protein, 845 aa, Acinetobacter baumannii
TRIDRNHQNGGSIMILRHNNLCKSILLILLSGGCLNIPNTVFAGDLPPPPRDINEINQLFKLYLDLVVNQYSVQQVVPVIVKNDEYFIQKKKLIDELEIKIPQELLTNTDTSLSNQDVLTLGFSGDASDWISLDKLKDVSYEYQSSNQYFKLNFPPAWMPTQVLGKDSWYKPEVAQSGIGLLNNYDFYTYRPYQGGSTSSLFTEQRFFSPLGVIKNSGVYVKNHYKNEGNAESVDNDGYRRYDTSWQFDNQKNATSFLLGDIITGSKTTWGSSVRLGGFQVQRNYSTRPDLITYPLPQFIGQAALPSTVDLIINGQKTSSTEVQSGPFILNNVPFINGKGEAVVVTTDAVGRQVTTSVPFYISNTLLKPGLFDYSLSLGKIREDYGLKNFSYGKFASAADARYGVNDWLTVEGRTELSSDLQLLGAGSVLKLANLGVLSASFTQSKADKSMSGDRTKDLEGNQYTVGYSYNRNRFGFSINHNQRDDEYTDLSRLQYSNLISVNSNKSLTANTYFATKNSGTFGVGYINTKANDFKNRFLNLSWAPVLPTYMNGVTVSLSANRDFIEKEWSAAFQLSIPLFQRNATVNSGYAFNKQGDTGYVNFNRSVPSEGGFGVDLTRRFNENSEDLNQARVNYRNSYINTDFGLSGNHDYNYWFGLSGSLIYMAGDLFASNRLGESFALIDTNQVPDVLVRYENSLIGRSNKKGHIFVPSVTPYYSGKYSVDPIDLPSNFTITQVEQRIAAKRGSGVVIKFPVHQSISANVYLTQTDGKPVPVGSVVHRADQESSYVGMDGIVYLENLKPNNTVTVQRSDQSICKADFSVDVEQAKQQIVVVKPVTCHEVSLP

SEQ ID NO: 7018 - protein, 363 aa, Acinetobacter baumannii
TESDKLAKSVKFFYCVDTKAIGYRCITLMSVTEKETSNSLYRQWQILSRLPTGKWIGTRELQEMLEREGIEISLRTIQRDLNQIAQRFPIESNKAVPQGWRWQSDAPIQSLPHMTSSQAVTFMMVEEHLKHLLPPSLLDEMGPWFDLAKRSLSTQNNVRQWINRVRIVPASQPLIPPVVDRAAQQAIYEGLLQDKQIECVYRARVNQGEDKTYILNPLALVQKGAVIYLICTRHDKTEVQTFALHRFKSAKVLESRALHPVNFDIDHYIDSGALGFRVDYNQPTESIQLTLTMTEQTAKTFYESQLSKDQTITPIEENIVEVTATVPFTSQLVWWLRSFGKKLLHIEPVQVHNAVREIEPDSK

SEQ ID NO: 7019 - protein, 182 aa, Acinetobacter baumannii
VTYEVTLMLFILICNFSCYILSILLIALFFLLMRTDNKLSRILHVLLHMARQNRSFTSEEIAKMLSTNPVVIRRTMIGLKQANFVQSEKGPGGGWHLIGDIEKITLFDIYNAVGEPTIFAIGNERQNPECAVEQVVNAALDASIQAAQAILIQRLKGTTLADLAKSFDQICIEKGWDSKHSH

SEQ ID NO: 7020 - protein, 281 aa, Acinetobacter baumannii
LMNEKQTRCPKCLTVYKVSLTQLTVAQGMVCCPKCNLNFNALTNLVNVEQPETVNSSALAHGSMQTRYMTHSHVLDIFDQKVENSNIDLLTYLNNLNYFHNEPINALPNLNLAEQATSPEQDNGKKHSWLYYTLWSSANLILILVFTFQILWFNPKLMQQSPAISHAFNYVCQILHCNKSAEQYQLLYIEKVKLRKIGTEHTQLSGVLINQNNKSIELPNLKLSFGKGTDQEEIIFTPQQYLVENLRGIQRIPTNTPFRFQVELNKSKKSLVNYRLEIVHP

SEQ ID NO: 7021 - protein, 280 aa, Acinetobacter baumannii
YMSDSLNKAELNHFLAQQALKSQKKHLNHKFTRWFKALLIPLIFLAAREFLARNGYIDAYLLPAPSSLWQSFLDLAHSDLFAHIYISTWRVLFGFIIGSGLGLIFAIWVGLSKEAEAYLEPTFSAIKSIPSLAWIPLLLLWLGIDEGSKITLIAIGAFFPTYTNTVAAIHNVDKKLIEVGKVYRLNAFQRIISIILPAASPGILTGLRNSLSLSWMFMIAAELIAATQGIGYLLSDGRETSRPDIVIIAIILLALLGKITDTLMKLIENWLLRWRDTLQK

SEQ ID NO: 7022 - protein, 259 aa, Acinetobacter baumannii
RVTELQDIDFVELSDEEMHLYSRQILLDGWDIEAQEKLKLANVLIVGAGGIGCSSAELLARAGVGKITLIDADTIEISNLQRQIAFGHEDIGRYKAEVLAKRLQKINPYICVEYFNERLDEHNIDKLVEHQDVVLDGCDNFTTRYLVNAACKKHQVALISASAIGFQAQMFMVEGDSACYECLFPKEQHANEGLRCAESGVLATTPVMIASLQAHHALLYLGLNRTPLKQKLLLWDGLNMTQRIVSFDKDINCPLCQAS

SEQ ID NO: 7023 - protein, 126 aa, Acinetobacter baumannii
HRLDLCIQRRLLTGSSLMSSHEHNAAGASHGNFKQYTVGFILSVILTIIPFGMVMAGGFSRGLLVTVIAITAVAQVLVQLVYFLHMNTSSEQRWNMIAFIYTILCIAVLLIGSVWIMNYLHYNMMI

SEQ ID NO: 7024 - protein, 913 aa, Acinetobacter baumannii
KISLEFFMPSKIKFKQSTLSHSMHLILKMQSIPKLICSSLLLSLCVTPCYAQSSAETVTAEANQSVTDSLVQQTNTNNPSDVPITDVATLVTQAQQQQDSLAILQQQEQFPNQIEEFKPITLDNLEDLPVMPVDQNMANEIYRVAEEAKNEAQNFQNGTQKQPEMVVNDASQAELHEINQAPVNIDQLMHEIQSDSKIVVEANETGKTLPELTAAVEEPPEEKGFFRRIFNKIRPPRVIPMEQIPRITAEVTGAPDDLAKNIKGKLSTFTQESFEDFNAALPQLRSLSNQAAQAVGYYNAEFRFEKLSASRVRVNVTPNEPVRINEQNIEFTGAGAKQPQFQVIRLVPDQDVGDIFNHGLYETTKSRIVDAASDNGYFDAYWRLHDVKVSQPENKADINLKYETGERYKLGKVEFRMSDPSKPLPLNMNILESMAPWKEGDDYAFWRVNVLANNLTNSRYFNYTLVDSIKPDPIEKPLELPPDLQALVDQQNVDIDESKLLPLEQQQLAKARQLASSSKEVTQNVVDEKQFAGTESVQAAPASLKAATVQHEEQESEQDRLQAQAREEKRIPVIVTLNADKLNSLETGIGYGTDTGARLRSQYRRSIVNKYGHSFDANLELSQIRQSIDGRYSIPYKHPLNDYFNIVGGYERETRDDIGPDVSLLTESAVLGGERVIKKPLGNWQHTIGVRYRLDRLTQKGNVDISELPDAFKTAASEQEALLFSYETSKTSSNTRLNPTKAFKQTYKLELGSESLLSDANMAIATAGWRFIYSLGENDDHQFVGRSDFSYIFTDEFDKVPYNLRFFTGGDQTIRGFDYKSLSPEDNGYKIGGQALAVGSLEYNYQFKEGWRAAVFSDFGNAYDKSFSNPTAYSVGVGIRWKSPIGPIRLDVASGISDDNHPIRLHFFIGPQL

SEQ ID NO: 7025 - protein, 494 aa, Acinetobacter baumannii
NPFCVHILSSGLIMSQANATSLTLSSPTENKTSESGQLKEFRTPPHNLAIEQAVLAALMTVAESFEQVSDLLKENDFYATRHKYIYRAIEKLAQENSPYDAVLVNDWLLKQNLLDAIGGEEYLMQLMADSPSSFYNLETYATKIKEFSTLRSMIKVSTEILQNAYDTKGRGVSEILDLAETSIFSLAEQHNNNKKDSGPKAISSVTADVISKLDELSKLDGNITGLTTGFLELDNKTSGMQPGDLIIVAARPSMGKTTFAMNLVESVLQYNKLPALVFSMEMPADSIAMRLISAMGKVHQGHLRSGNLDADEWTKVTGTILQLQQMHLYIDDSSALPPTEVRARARRIAKMHDGKIGCIMVDYLQLMKVPGMGDNRVGEISEISRSLKALAKEMNCPVIALSQLNRSLENRPNKRPVMSDLRESGAIEQDADLIMFIYRDEVYNKESKEAGTAEIIIGKQRNGPIGTVRLAFEGQYTRFSNLSPEYYSQYDDEE

SEQ ID NO: 7026 - protein, 91 aa, Acinetobacter baumannii
KITCKFQLSQSFTSNMDYKILLEFKPKVNERGVFLRDAHYFVTKYPCINNDLNNGFIMRYFKLKEHSTLVECLTMSYTLRIFCSLAFCHVG

SEQ ID NO: 7027 - protein, 365 aa, Acinetobacter baumannii
YNSCNAKQAKTLCLFFLFSIVFDDMIQFKNISKHYQLKGQTIRALDQINLEIPEGSIFGIIGYSGAGKSTLIRLINLLERPNEGQVIINQKDFTALDARSLRQERANIGMIFQHFNLLQTKTVAENIEMPMRLLNYSKAEREKRLNELLEFIDLKHKKDAYPDELSGGQKQRVGIARALANHPKILLCDEATSALDPQTTKSVLELLKIINQEQKITIVMVTHEMDVIETVCDHVAVMEAGKVIEQGSTIDIFSNPQHPTTKNFIQTVLHQQLPVNILNQLENQHHHSIYCLQFLGRSAQEPVIQSLIKQFDISLNILFANMTEINGTVIGQMFVQLLGDPQLIRQAIEFLEKNEVSVVQSGDQV

SEQ ID NO: 7028 - protein, 304 aa, Acinetobacter baumannii
EPTRVVEISHNQDFFYMKKLISLFLSVSVVLLAACGKQQNEPQNGKDSAQLQTVVIASTGSDADIWRYIATLPETKAAGLKLEVKNFTDYVAMNTATANKEVDLNAFQSYAYLVAFNGSNKDKIAPVATTYLEPMGIYSSKYKKVDEFPQGASIAIPNDAANEARALLLLQSAGLIKLKADFDPAKGTPSDITDNSKKIDIKPIQMATAVRVKDEVDAIVLGNTLAMEGGLNVLKDSIYYEPVDQSTKLNVNILATAESRKDDPVLQKVGQLYHTEAVKKYVEQHFGGTKVDVNQPISYLTQAK

SEQ ID NO: 7029 - protein, 358 aa, Acinetobacter baumannii
MRVRQATVYIDRQALQYNLNRVKQLAANSKIVSMVKANAYGHGVKDCLAALNASDAFGVACLQEGLEIRELGFEQPVTLIEGVFSEDEMPVAIEQKFECVIHHQQQFEWLIKHKQAYIAQGLKVWVKLNSGMNRLGFKNPEIIEVIKTLKSEGFTCVLAMHFANADVDHPLNEQQKQQFLHIKETCDPILASCCNSAAIFKWPELNFDYVRPGIMLYGASPFADKTVHDLDLKPVMTFTAEIIALNHIKAGEHVGYGSTFCAQQAMDIAIVSIGYGDGYPRAYVKQNFVAIDSKLCPVVGRVSMDMIAIDVTNTQVKLGTQVELWGNHRLVDDVAEANGTIGYELLCRLSSRPVRQGT

SEQ ID NO: 7030 - protein, 69 aa, Acinetobacter baumannii
LLALKFIQKNPSSAWIFYLVNFKYPDGLGENLDGKVIHNRLYHLLQPHHQLDGDFPKVQLGCQVLLEYL

SEQ ID NO: 7031 - protein, 75 aa, Acinetobacter baumannii
DTDRRSSHVKKVVKAKNLIAFRIWLEKLGYSVKNLADGKGFTFSFKKEYGLVTCDLAGNALAMQLGEEFEDHLKA

SEQ ID NO: 7032 - protein, 241 aa, Acinetobacter baumannii
SECSSIRRSSMRDLIVQWLTELTQPFWHSSLSIDQFVTALQETFHMVFFALLFGGIWGFIQGIILLVTRPEGILPNKFIYHLINPIVNALRSLPFIILLIAVIPLTKLLVGTSIGTWAAIVPLTIYVGPYMGRLIETSLLEVNEGIIESAQAMGATPWQIISRFILPEARSSLILNLTTATISLIGATAMAGAVGAGGIGDLAISYGYQRFDTSVVILTVIVLLLLVQIVQMLGNWLAKMR

SEQ ID NO: 7033 - protein, 571 aa, Acinetobacter baumannii
NNNSQDRFCSLTQNQSSNGMKVSIMKTLAEAYQQFDLTRLIEEQLVGHPQAINAYVECCERYVGKNKTALIWEGKNGQAEHYTFEQLAELSGKLANFFKAQGIQAGDCIAGLLPRTPELLITILAAWRIGAIYQPLFTAFEAKSIDHRITTAQTKLIVANDEQRPKLNTLNVPVIVTVHQTGLLSEHDFDFWQSLQRYSEQCEPVNRSFDDDFLMMFTSGTTGLAKSVPVPLKAILAFKGYMTHAVDLREEDMFWNLADPGWAYGLYYGITGPLSLGHSIIMDERSFNVDQAIELIKKYKVSNLTGSPTAFRMFFGFKEKFDPSIKQHLRVVSSAGEPLTPEVVNWFKQNLEVNIFDQYGQTELGMVIANHHALEHPLKVGSAGFAIPGHRFAVLDQNYQELPTGGVGILAMDSEQSPLMWFKGYGGNNRKAFVGKYYLTGDTVTLNEHGGIDFVGRADDVITTSGYRVGPFDVESTLLECEAVLESAVIGKPDPERTEIVKAFVVLKPAYQACETLKDKLQQYVRNRLSRHAYPKEIEFVDSLPKTTSGKIQRGLLKQQEIAKMQQAYAS

SEQ ID NO: 7034 - protein, 153 aa, Acinetobacter baumannii
YLCRPTFENGSKYGTCFVVKALRSVKFMDAIIIEGLKVETVIGCFNWERQIIQPLMLDLTIHNDLSRAAASDKLEDTLNYAQICELSAQTIQKAKPELIEHAAHLVLQCLFETFPTIEKITITIRKPAIIAEANAVGIRLERTRNNFCARSSE

SEQ ID NO: 7035 - protein, 287 aa, Acinetobacter baumannii
ISGRSACDACTGKWRLMNIAQALAIRGEPDSYERQENAWLLEYFLKINSLELKFRLEQELTAQQEQDYLAGLERIQNGEPLAYVTGSQPFWTLDLKVTSDTLVPRPDTEVLVETVLNLNLPKNANIVDLGTGTGAIALALASERPDWFVTATDIYAPTLDVAKENAQTHGLHHVKFACGAWFEALEPQQFDLIVSNPPYIDPEDEHMQALATEPRRALVADHHGLADIEIIIAQGKNWLKPQGWIALEHGYDQGQAVRGIFAEHGFSEIKSIQDYGRNDRVTLACWI

SEQ ID NO: 7036 - protein, 800 aa, Acinetobacter baumannii
YCKSGVKTLEARVIGLEKLGKHDVELVGGKNSSLGEMISHLSNAGVSVPGGFATTADAYREFLDQSGLNARIQAELAELNVDDVNALAETGAKIRQWIVETPLTPGLEQEIREAFAALSNGNPDIAVAVRSSATAEDLPDASFAGQQETFLNIRGIDNVLIAVKEVFASLFNDRAIAYRVHQGFEHSLVALSAGVQRMVRSETGAAGVMFTLDTESGFRDVVFITASYGLGEMVVQGAVNPDEFYLSKPLLNAGKHAVLRRNLGSKHQKMIYGEEGSAGKSVVVVDVEKQERQQFALNDHELQELAKQALIIEKHYGAPMDIEWAKDGDDGQIYIVQARPETVKSRQNVGTMERYLLKQKGTVLCEGRSIGQRIGSGKVRIVNSIKEMDKVQDGDVLVSDMTDPDWEPVMKRAAAIITNRGGRTCHAAIIARELGVPAIVGCGNATEVLTDGQEVTVSCAEGDTGFIYEGALDFEVQRNSIESMPKLSFKIMMNVGNPDRAFDFAQIPNEGIGLARLEFIINRMIGVHPKALLNIESLPRETRAAVMTRTAGYASPVEFYVEKLVEGIATLAAAFADKPVIVRMSDFKSNEYANLIGGKLYEPEEENPMLGFRGASRYVSDNFRDCFELECRALKKVRDEMGLTNIQIMIPFVRTVSEAKRVIELLAQNGLKRGENGLKVIMMCELPTNALLAEQFLEHFDGFSIGSNDLTQLTLGLDRDSGIVSHLFDERDAAVKALLSMAIHACRKAGKYVGICGQGPSDHPDLAKWLMEQGIESVSLNPDSVLDTWFFLAEEKIKQI

SEQ ID NO: 7037 - protein, 268 aa, Acinetobacter baumannii
DRERMNRLLVTSLIFVCSYSLAHEPYVAPLAYKTEQTQVPVVAGYAEEALNSEYALKDAKLTVITPKQDPKVINAEALHKSVTVFDVALPEDGTYILQTQATYPLKYVYDQKEWHLFFDLPADKAPPRKERDYLIPADLKTKKIKTEEVTREWVLQSYLSKGKVSDIQLPNTPVKVNFSVHPNQLKVTQAVQLTISEKGQNLPYAEINLREKGVTDKQVLHFKADDKGQVELKFPKAGEYLMEVTAPVDLKLKPKNQNYTIVSLQVTE

SEQ ID NO: 7038 - protein, 684 aa, Acinetobacter baumannii
RLRRRVKMNTQTHVNSHKQTMAVPNFEVWKNAFVKLLPQHAIKNPVMAIVWLGTVVTGISTILGYTTLLFGLVVTAILFITILFANYAEAVAEARGRGQASSLRAARENLTARRLNSLTDRQATQVAATQLHLNDFIEVHAGELVPADGEIVEGFATINESAVTGESAPVLREAGTDRSGVIGGTKVLTDRIVVQVTAESGQSFLDRMIALVEGSNRQKTPNEIALGFLLMVMTITFLIVVISLPFIAHYLHIELDPVVLVALLVCLIPTTIGGLLPAIGIAGMNRALKANVLAKSGKAVEVAGDIDVLLLDKTGTITYGDRQATSFYPLTSVTESELRAAAWISSLADPTPEGKSIVKLAKEQGLKQQEPEQAEFISFSASTRISGVNLPNGDQIRKGALDAILKFVDEDYSQDLELKARVEQVAKKGATPLVVANQHHVLGVIELSDVIKHGIKERFARLREMGIKTVMVTGDNPLTAAAIAAEAGVDDYIAEAKPEDKLACIRTEQQQGRLVAMVGDGTNDAPALAQADIGLAMNSGTQAAKEAGNMVDLDSDPTKLLAVVEIGKQQLITRGALTTFSLPNDVSKYFAILPALFAAAIPQMQVLNVMHLASSNSAILSALIFNAIIIPLLIPIALRGVKFKPSTATQLLRRNMLVYGVGGVVLPFLAIKAIDVVIVQLFGL

SEQ ID NO: 7039 - protein, 67 aa, Acinetobacter baumannii
LSFGPSARYHHEWGHLLLAKWRLFSIGGHFYGEYFYSDAKASYFVFPVVGCIYTVIRGVEVCTGAMH

SEQ ID NO: 7040 - protein, 361 aa, Acinetobacter baumannii
LGNGTLHRGCKMRQTILAVLSLSTLAALLTGCGGDMVLLNSKGPVGQGQSDLMMTAIYLMLLVVIPSIIMALWFGWKYRASNKDADYKPTWAHSTAIEVVVWGIPVIIIGILAWLTWWGSHKYDPYRPLESDKAPLTIQVIAEQFKWIFIYPEQNIATVNEVRFPEKTPLSFKITSNFTMNSFFIPQLGGQIYAMAGMQTHLHLLANETGVYRGFSSNYSGYGFSQMRFKAHSVTEQQFNEWVAAVKAGNGTTINPEAVQKTTLDQAELATLRDGDRSKHQIEHLVNRAKAAGDQEALAKAEAMKPFPTKPHPVTYYSSVEPKLFETIINHYMSNYHGADHSAAHTAAETHVAAEHAAQGE

SEQ ID NO: 7041 - protein, 215 aa, Acinetobacter baumannii
KCDGFYIFIHCCGSLWKSVSKHSYRLHWVFQHLHIAIIYSSYFPKSLINRDGQYKREGNMPKFLIIAEKVYKKLEEDKLFSDNLIEQLNNLVSIIRKEIKGTPCKLKYNFIDFEECLSKPLSECTIKLDMSLMPKYKNKGEYIMWLASFIERITVGGQPKLPPLSSIVPADFNVKKEAQTIVENKKSVSEENAKMIVNYFNSEEYQKNNKKINLV

SEQ ID NO: 7042 - protein, 280 aa, Acinetobacter baumannii
NCIGKKQLLLSLLSLKNISIGHYIMKIQGKHFVITGGGSGLGAATAEYLVKQGASVTLVDMNVEAGEQQAKQLGPKADFVKLDVTDEAAAEQFFKDVLVKHGHLHGLVNCAGIGPSAKVVGREGVHDLGLFAKTLNINVTGTFNMLRFAADAMSKNTVEEGEEDRGIIVNTASVAAFDGQIGQAAYSASKGAIVAMTLPIARELARHAIRIMTIAPGIMETPMLKGMPQNVQDALGQMVPYPSRLGKPEEFARLVAHIAENSYLNGEVIRLDGAIRMAAK

SEQ ID NO: 7043 - protein, 444 aa, Acinetobacter baumannii
EIEGDEKGLKLRNKLKMNILVLGSGGREHALAWKIAQDAKVTQVFVAPGNAGTATEPKCVNVQLDILDNPAIIAFAKENNVELIVVGPEAPLVNGVVDAAREAGVKIWGPTQYAAQLEGSKAFAKHFLKRHNIPTAFYEVFTEVDAAKAYVEKNGAPIVIKADGLAAGKGVIVAMTNEEAFAAIDDMLAGNKFGDAGSRVVIEQFLAGEEASFICMIDGKNILPMATSQDHKRIFEGDQGPNTGGMGAYSPAPVVTPDVFERVMNEIMRPTVDGMAADGHVYTGFLYAGLMIDEQGQPRVIEFNCRFGDPETQPIMMRLKSSLVDLVEAGIAGNLPSEAEWDERKSIGIVLAAEGYPDSVRKGDVISGIGQSPEDTKIFHAGTATREDGHIVTSGGRVLCVTALGDSVLEAQINALEVCGQVTFTGMQYRSDIGYRAIAREKAE

SEQ ID NO: 7044 - protein, 67 aa, Acinetobacter baumannii
YPFFFKFLSSTETRTLHNAAANINTICKEPINLNFKKQRWTAGSFNMLFYSFKAIKKPVITDWFFSS

SEQ ID NO: 7045 - protein, 305 aa, Acinetobacter baumannii
HTFMSSSIEFFPPMIDGVSASQVYLPPQTIAQTIYQFLCENFPHIKATEWQQRFQDGLIYAANGEKLTLNSSYIANTHIFYYRFLANEVHVPFEHQILFENDDLLVVDKPHFLTISPTGQYVQETLLVRLKKQTGNEFLTPIHRLDRETAGVVLFCKRPQSRGIYQQLFADRQVNKIYHAIAAYKAELKFPQNLKLYLDKGTPFYTMQVIAHTKTNTETKIELIEHNHSWAKYCLTPSTGKQHQLRVHLNHLGIPIKNDPFYPIVQHKADDDFSQPLQLLAKQISFIDPLTKQEMVFNTQLELTL

SEQ ID NO: 7046 - protein, 1504 aa, Acinetobacter baumannii
VYFMAEVEQQPTSAPSSPKKRRILRSFLLTILIILLLLVASIIIMMSTDRGSRFLLDRVLQAQQVIKYEYEGGNLLRGIILKNIIVQLKEVDVTLDRADVRLGWRSLILEKEVHLSNADVRNLVIINKAPPSDKPFEFKPIKLPFVLRVDVGDVDHLEIKNSGSVVNFHDVHLNDALWSETKLKFENSSMDMGYLSVHNATGNMDFSGKYPLNATADLRIPSLKSLNIQNIKVAARGSLDTLQAGVATTTPDLLTGWVVLHPVRHEVPMQGALLLKNYHLPLLVEQKLFAKNGVIKFQGDVKQLNLALETDLKGENLPEGQYNALMNTDLVHQLNITDFNGQVMKGAVNLKGLVNWKDHVTWDIKGRLDHVNPKDKAIPQVVQDFLPPSLDAAVSSTGSLEKGTEVFANVDFDRYESWKLKLNQAPEKNKKPQPMFMNVAWANIDRAMPYIGWLSSDSGQVDLTLRDGQQDIKVSTKVYQHEQTLLPAGQYLATLNVKDNILNVPSFSFAAQKGSLTGQAKVLLPSEKRQLAWNALLNAKDFNPQSIHTAAPVNLLNGSIKASGFAKPNQQIIQLEKIDLKGRLAQAGQEMVALAGKSTAALLFNDVKAGGGFKGFAVNYDGSLKALNQANGLLKFSIAGTPEFIRISQLQHDGVAGKIYATGALNLKDRIAWDINSSLVRFKPQYFASSVKGEISGNVKTQGIWSDKLKRIDIQQLNLAGYLNNKPVRGKGNLSILMDSNQKGFLPQQFEANNLFLVYAQNQLQATGNAQNLKIKLNAPALYDLYPGLSGRAYGDLSVQSQPRLKATANIAVDNFAFNTLVSIKKLRIQGELPTSETTPTQLTAKLDNLRSGSRQIQSAEVNLTGTRKAHLLKVQGNNNVSKFYVQLAGGFNAKNDWLGQIQKGSFDSRRIRLAQNQNAPVVFSSARSELYVGQHCWQSTNSQLCLDQPVRVSKAQGNISFVTQNLDLGDFAAFMPEGLAMTGQLNGYAKASWVNGGHPKLDARLVTRKGELGLAAEDPQDPPTTLAYDELSVIAKSISEGLLFRVDVKTPDIGTGYANVIINPYQSSMPMHGEVAFNDVQLKVLKPFIQDVRSMSGTLALAGKVNGTLTQPQFTGEMRLKNGAISMISLPVNLTNVQVYSSIRQDMATIDGAFNSGQGVGLLKGSFDWKNAPRLQLNLKGDNLLVRQAPLITAIANPNLTLDMYPFDKRLSLKGSVDVPRARISMPETTAPVVNTSSDVRIVRQGQDPLAILRAAKPWDIRADISVNIGNQVIFQGFNSNIPLVGRLNLTQRGYETAMRAMGAIGVSQKVKIEAYGQSLDLNRAIARFNGPLANPTLDIDANKNVQGSMVGVRVTGTASSPNIQVYNDAGLSEQEALNALVTGRINEGASGLSNAEGFKSDVNNTIAAAGISMGLGGTRALTNQIGRTFGLSGLALDAQGTGDDTQVSLTGYITPDLFIRYGVGVFTPVNKLTLRYQMNRRLYLEASQSLERAIDLFYNWRF

SEQ ID NO: 7047 - protein, 153 aa, Acinetobacter baumannii
VYFMQILRLSDYPQYKEMAAQWFSEKWQIPVEAYLESIQISIDQRHAIPQWYIVLNENKHLIAGAGVIDNDFHERKDLTPNLCALFVEENYRNQNIAKQILDFVREDLSNQGIQTLYLITDHTEFYEKCGWRFLTLVKDEEGEMVRMYVADTF

SEQ ID NO: 7048 - protein, 208 aa, Acinetobacter baumannii
SITMKLKELAGCEECDTVYRRVPLAYGKRAYCVCCGAELYRHTKPFTTLLALILTALIVFVIANSFPIVKIELQGNISETTLLGAVWVMFHYDRAFVGVLILITTFIVPLTYLLLMGYVLGTVSILKKRPQFLVGALRTLYFMRVWGMVEVFLIGILVTLVKLMGMVLVIPEIALWAFAVLSLLMVYITSVKVSDIWNEIDRSQPWQK

SEQ ID NO: 7049 - protein, 257 aa, Acinetobacter baumannii
WQTILNNILNLLFVVRDQRLTMKNKNNRSLQHSKVAKWLLGSGVLLTAIAMTACSSSPTPNYYTLTPKVTPVSNSTVQVIEVLPVGIPDRLDRAPLVLQDSNGKSTVLDNERWTSTLGTQLRDTLSAGLQQKLGAIDSYSSGLSGNNQPLYRVSTDFSHFDIVDNSNINVAVSWVVKRQIPPTQLESTNPKVISNRGAQLNCRIAFKQSIDQKAKKMEAIVGASNEAMSQIINTISSSIVALDSNKKMNINNGICSS

SEQ ID NO: 7050 - protein, 347 aa, Acinetobacter baumannii
EAYMKYIIGVLCVTYLPAYAFAEQLQDNTNVPVPSIPDTIDSKSKNTQIKMNEQEQDNNVAQLFLNISINSNPSEDLVAVRQDQDKKLYIRARDLKTLRLKMDDSISDSQWICLNELKDIRFKYLENEQSLNLQVPPHMMTGYSVDLKGQQITSPQLLKIKPLNAAILNYSLYHTITNDENVFSGSAEGIFNSAIGNFSSGVLYNGNDKNSYSHEKWVRLESKWQYVDPEKIRIYTLGDFISNSSDWGSSVRLAGFQWSSAYTQRGDIVTSALPQFSGSAALPSTLDLYVNQQKIYSGLVPSGPFDIKQLPFISGNEVTLVTTDATGRQEHYQKALLFFIQDSGKRY

SEQ ID NO: 7051 - protein, 97 aa, Acinetobacter baumannii
YLIFGLTRMNSKSPIFTAQSDVALRIHVDRAVRHYFAQLQGEQPSQVYDMVLAEMEKPLLSVVLEYTRGNQTRAAEILGLNRGTLRKKLKAHGLMSE

SEQ ID NO: 7052 - protein, 230 aa, Acinetobacter baumannii
ETHMLKTIFQKFQKKQGCVVIAGHDIELLDQNFVILDKNEQSPLHVYQAVHDSSVQNIQVNRVNDGITSVRLNLVNTEHLKSLLKYIASHSHSIELCVFQPNFSSAPNIEALSLEEIEHSWQTTGLSAVSVSQAVIKPMLKQQRGTVIFLGAPSNNSAHYDVLSQSMFASIRALSQSLAREFQPKGIHVTYCMVEKWDGQNQHFISSVKQVCQYIYQQPNTAWSQELSVS

SEQ ID NO: 7053 - protein, 185 aa, Acinetobacter baumannii
MLNIKNIQQTVKVATTLAALMCFSSLAQAYQYEQTARLINERLSYMKDVAGYKAEQHLPIEDLTQEKKVLDQSLSEADAFGLNSETVKPFIVAQMDVAKAIQYRYRADWLSSPETNWKPQDLSEVRVKISALNTELLKNIAYELKKNNNKAPHGCSYMWPVQHPQLKEADKRALCVTLNKIKLKQ

SEQ ID NO: 7054 - protein, 178 aa, Acinetobacter baumannii
LINMNTISATLLYEHPIEGCTKDSNGNLKPFPILAIDNIPLNIWVHQNTHITDLAETLVPAQGWLYDYDSELALSNAWKLLKPQTYENVSISTVVPILICPDDLDLVCNVVMVEQVVSADQVVWARFGYAFNHIHDVVTSVVWETPPSAPQLSFPLSEFEKAYNDLKELDKKWTENFI

SEQ ID NO: 7055 - protein, 181 aa, Acinetobacter baumannii
VMNMKNIQKSLLAALIVAGYAVNTQAAVTGQVDVKLNISTGCTVGGSQTEGNMNKFGTLDFGKTSGTWNNVLTAEVASAATGGNISVTCDGTDPVDFTVAIDGGERTDRTLKNTASADVVAYNVYRDAARTNLYVVNQPQQFTTVSGQATAVPIFGAIAPNTGTPKAQGDYKDTLLVTVNF

SEQ ID NO: 7056 - protein, 664 aa, Acinetobacter baumannii
DMDMIFGKLGWDSIPTEPIVLVTMVFMALGAIAVLGGITYFKKWGYLWKEWFTTVDHKKIGIMYIIVSVVMLLRGFADAIMMRLQLFLAKGGGEGYLHPDHYDQIFTAHGVIMIFFVAMGLVVGMMNISVPLQIGARDVAFPLLNSLSFWLFAGAAGLMMLSLVLGEFAATGWMAYPPLSGIQYSPGVGVDYYIWALQVSGLGTLLSGVNFFVTIIKMRAPGMKLMDMPIFTWTSLCTAVLIIASFPVLTGTLAMLTLDRYFGFHFFTNELGGSPMLYVNLIWTWGHPEVYILVLPAFGLYSEIVATFSRKALFGYKSMVYATIAITVLAFVVWLHHFFTMGAGANVNAFFGIMTMVIAIPTGVKIFSWLFTMYKGRITFTTPMLWTLGFLVTFGIGGLTGVLMAVPPADFLVHNSLFLIAHFHNVIIGGVVFGMFAGIIYYWPKMFGWKLNEAWGKAAFWFWFFGFYFAFMPLYILGFMGMTRRLNTYDNPEWDPYLAIALFGAVLVAIGIACFLMQIIVGFLQRHQNMDYTGDPWDARTLEWATSSPAPFYNFAHEPDASGIDRFWTDKENGVAYARNTKYEDIHMPTDRAAGFVIAMFITLLGFALIWHIWWLVVVSFVAAVVSLIVSSFTKNVDYYVPAAEVERIENERYALLEKHLKKD

SEQ ID NO: 7057 - protein, 228 aa, Acinetobacter baumannii
MSDIILHQWEISPFCQKVARALKFKGIPYETINYNGILGAKVPLLSKVGKVPVIDHKGQRIQDSTRIARYLDETFPGTLRLYPEDPNQKALVELWEDWADESLYFYEVYLRVNDSEALEEAIRISSIGRPAYEKPMVKGFILAELKTQLFFQGLGRMKAKNVEEEFIRHLDRIEQVLSQSEWLVGENQTIADIAVVAQLGEVIRTSKKFGKEILDRPFMAEWYKKQTG

SEQ ID NO: 7058 - protein, 243 aa, Acinetobacter baumannii
IICMNTTNAFPKTIYAIQHLAFEDLGSLEDVFYQLGFRVRYFEAGVDDLTPAFTHDGLTIILGGPIGVYETEDYPFLKDEIALLKQRLAADKPTLGICLGAQLIAHALGAKVYAGHQKEIGWGTLSLSLRPNQVLSPLLNNVHVLHWHGDTFDLPENAVLLASSEIYTNQAFEVGNNILALQFHIETTEENFEKWLIGHTCELRNAKISIPKLREENLQYAQALEHAAFEVIQKFLKRIGYSG

SEQ ID NO: 7059 - protein, 191 aa, Acinetobacter baumannii
RVNHKKDSILQDIKTIHERPAEVQERKIPGHWEADLIKGKDNKSSIATLIERNTRLCILATLPDAKAESVRKALTEALKYLPAELRKTLTYDRGREMSEHKILEEDLGIDVYFCDPHSPWQKGTCENMNGLIRQYLPKGIDLNQADQHYLNQVAMSLNTRPRKALDWLTPLEKFAQLVDYHMAFETVAPHV

SEQ ID NO: 7060 - protein, 480 aa, Acinetobacter baumannii
GQGIRPGTYCEPKMTTVGSQDTTGPMTRDELKDLACLGFSADLVMQSFCHTAAYPKPVDVQMQHTLPDFIMNRGGVSLRPGDGIIHSWLNRMLLPDTVGTGGDSHTRFPIGISFPAGSGLVAFAAATGVMPLDMPESVLVKFKGKMQPGITLRDLVHAIPYYAIKEGDLTVEKKGKKNIFSGRILEIDLTEMETDLTVEQAFELSDASAERSAAGCAITLSEEKVAEYLRSNITMLKWMISQGYGDARTMARRVENMEKWLANPSLLKADADAEYTKVYEIDLSEIKEPILCCPNDPDDAKLLSDVQGDKIDEVFIGSCMTNIGHFRAAGQLLEKVPSGSLTTRLWLAPPTRMDEHQLMEEGFYNTYGRAGARTEMPGCSLCMGNQARVAPNTTVVSTSTRNFPNRLGQGSNVYLASAELASVAAVLGKLPTPEEYQQYAAQIDSMSADIYKYLNFDQMGEYTNAADKVDTKKIAAAQLT

SEQ ID NO: 7061 - protein, 308 aa, Acinetobacter baumannii
CNFISYLLRVHKMLYDVTIIGGSYAGLSAAMPLARARRNIAIIDAGQRRNRFAEHSHGFLTQDGTRASEIVEIAKNQLEAYSTVHWKNGWVKQIAKIDEGFCICIDGVVSIQTKKIIIAAGVNDQLPEISGLAERWGKTIFHCPYCHGYELQQGKIGILATSEHSLQLAMMLPDWGPTTLLLNGDDQLIHTEWHTSLQKRGVVVEPGFIQEIRANAEVVFTDGKIIALDGLFVPTRTYITQPWVAELGCEVEDTPFGQIIKTSATKDTTVNGVFACGDIARLGGSVPFAVADGMMAGVSAHRSLVFNV

SEQ ID NO: 7062 - protein, 65 aa, Acinetobacter baumannii
NIIIKDLAEDTVNVLAPRLGNLVIQQGSKIKIIQIFLYSIFYSKKPKNTGQIILLMSLIFLENYY

SEQ ID NO: 7063 - protein, 345 aa, Acinetobacter baumannii
VFVMVVQSSLSKGTISIALVHEALSAAYAKGLNTQIILNKAGIPAELLMTPKARVPVATYAQLWIELANAMDDEFFGMDSHPMRRGSYKLLTKLVSTAETLEKALYDILKFFNFVLDDIRGELIREQEKAYLVIHDQEQPKRMFTYATFLMLVHGLMCWLVDQRIGLNHIAVRCPKPNDIQDYLVRFCEDIEFNAETNQIEFDTHYLDIKIKKDKKALYDFLEQTPQNLLVRFKNENALSVVIRRHLLKLHPAEWPELKDVAQQLNISEATVQRRLKHEGVSYQQIKNEIRCDIAIERLSKSNDSIQDISEDLNFHDPSAFHRAFKKWTGVSPGAYRDNLTTFKQ

SEQ ID NO: 7064 - protein, 297 aa, Acinetobacter baumannii
NISIPVINPANAWNEGRIMKKLNQIMFAMIAASAALSANAAHVLVVLSDEGQLELKNKQVFKTGFYLNELMQPTKMLLDAGHTVTFATPKGKAPTLDESSNNAMYFNQDEKALKQYAGLLHDLKLTSAQDSPVVSLARIEQIGIDQFDAIYIPGGHAPMQDLLKDKQLGKVLTAFHKAGKPTALVCHGPIALMSTLPHAVEAVKQLEQGKKVKTGEWIYKNYQMTVISNQEEEQAKSLLKGGEMKFYPQTALESLGAKYQSNTKAWSPNVVVDRELITGQNPASAVLVGKSLLEKLK

SEQ ID NO: 7065 - protein, 148 aa, Acinetobacter baumannii
EFVLNAPETIFALALASNLDAAQHFTFAYTQLATLGKVQFSSVYQIPCRDGIGDDYWNSACLLKSTLSSEQIESFLKKLESDSGRVRPSHHISLDVDLIAWGSDLDHMQFNSKKLPLALDVKIPLYELWHCETLKADSTLYPVVNFKV

SEQ ID NO: 7066 - protein, 271 aa, Acinetobacter baumannii
VTAMAKIKNVTSEKITNTNMILKQYPRAKDLSLILCHCCGLLNSSKVNKTDAHKKQILRCVRCHSVLHERKPGSLNRTFALVVAATILYIPANVLPMTVTDSLLGRQQDTIMSGVIYFWQSGDYLVSVVIFMASIFIPMLKLLILYFLLLVVYIQSSAAWKFAPEQCIKLYRIVEFVGRWSMIDVFVVALLTALIQIQSLATILAGPGSIAFGAVVVLTMFASLSFDPRIIWDNFYASQNTNKPNRVSSEKNTIIQAEHSPLNNDSINPSQ

SEQ ID NO: 7067 - protein, 187 aa, Acinetobacter baumannii
AVYMKNLGASFRALHVLHIASDLFKQYGFHKVGVDRIISETKISKATFYNYFHSKERLIEMCLLLQKDTLMEKVRVEIETTHYSTFAHKLRQIYHLHANLKSAYYLLFKAIFEIKTSYPTAYQTAIRYRRWIKNEIFCLLMETKKAVSYAEAEIFIFMIDGTILGLLTSDRAEEQTKLLDYFLVRVN

SEQ ID NO: 7068 - protein, 217 aa, Acinetobacter baumannii
FIHILIETIQSRHKTIVSACAFFIIFSKFLITFSSRHKDCSLLKRAWSSTMKMNVWLASALIATTSMVTVAHADNGTRVAATSALGSVVGTAIGKSIGGTSGATIGAALGGAGGAAAASDRRNRTEAAIGGALGGGAGYTVGKNMGGTNGGYIGAAVGAAGGSALGRKVAQDRNYDDRYDRRYDRDDRRYYDGDRRYYRGGNYRHDNGLHRGWYKHR

SEQ ID NO: 7069 - protein, 443 aa, Acinetobacter baumannii
SLHMMKQDESLMTSRRFVPMFFTQFFGALNDNVYKQALLLVITYGWIQQQSAPVSTLNNLAALLFILPYFFFSATAGQIADKYERSQLVRGIKILEIIIMLIGSAGFLLGHLWLLLLALFLMGTHSTFFGPIKYAILPEILKPHELMSGNALFQSGTSMAILFGMILGGAVIASSDGNLLWISITVVAIACIGYLFSRFILPQKVAAPDLDIDWNFIRTSFQTIKYAKSLPLVFTILLGNSWYWFYGATYLTQIPQLTQQNLHASENVVSLLLTFFSVGIGVGSLLCRKIGGSEINIKMVPIGAVGLTVFALYLAASLAFVPERTGALLTLKDVFTQGWVYYHVMIAVTLLGISGGFYIVPLYAMMQAYSPRSHRARVVAANNILNAVFMVSSAIFSILILSVLKIDIKILFIITAVLSAIFSIWLLARLKPMLATAHLSLED

SEQ ID NO: 7070 - protein, 538 aa, Acinetobacter baumannii
LVLIRRLEIVDLNIMTIKRALISVSDKTGIVEFAQNLAALGVELLSTGGTYKLLKDNNIAVVEVSEHTGFPEMMDGRVKTLHPKIHGGILARRGLDEAVMQEHNIDPIDLVVVNLYPFAATVAKPNCSLADAIENIDIGGPTMVRAAAKNHASVGIVVNASDYDTVISELKASGSLSYETRFDLAVKAFEHTAQYDGMIASYLGARVGKAEGEADLFPRTFNTQLNKAQDLRYGENPHQSAAFYVEANAKEASVSTAKQLQGKELSYNNIADTDAALECVKSFAKPACVIVKHANPCGVAVSLDGIKAAYDLAYATDPESAFGGIIAFNRELDVATAQAIVDRQFVEVIIAPSIADGVLEVTGAKKNVRVLVCGELPAIDARAPQLDYKRVNGGLLVQDQDLGMITKDDLKVVTKRAPTEQEIDDLIFAWKVAKYVKSNAIVYAKNRQTIGVGAGQMSRVNSARIAAIKAEHAGLVVEGAVMASDAFFPFRDGIDNAAKAGIKCIIQPGGSMRDEEVIAAADEAGIAMVFTGMRHFRH

SEQ ID NO: 7071 - protein, 203 aa, Acinetobacter baumannii
SYPFSVLLRLNMSQSYIAPVELEKAYRLLNHGPTVLVSAQHGDDRNVMAAAWACALEFKPAKVTVVLDKSTKTRQLVEQSGYFTLQVPCYAQLNMTKQLGTISKLDDPQKLEHCGVELFYQKDLTSPLVSGCIAWLVCKLIPEPHNQSAHDLFIGSVVGAWADSRVFRDGHWHFQDAPKELRSLHYIAGGTFYLIGEEVKADL

SEQ ID NO: 7072 - protein, 168 aa, Acinetobacter baumannii
IMKICIVGPSGAGKTTLSHQLAKKLNISAYAFDEIYWNLNGTDFIKNSEEFISNGVKKISIQDRWIVEGAYDKRLLPLLLECSLILKMEVPFYLRTIRLLQRYLSSVVTDKEPKETLKNTLELIQFSHSFDKRLEKFLCSNAQLSKKTIPFNNFSKAINIIQTFFKNN

SEQ ID NO: 7073 - protein, 79 aa, Acinetobacter baumannii
FIEMFELIPINRKGKLREIRIIKAFLIFAFVLCLLILYIEYQKYAHINWKFVFITCLCIIWDFDLNKKIKELKVQIKSD

SEQ ID NO: 7074 - protein, 297 aa, Acinetobacter baumannii
SKLIVMLKKYLFLTKPGILFGNFITTLGGFFLAAQGSIDILLLLLTLIGTTLVVASGCVVNNVIDQDIDTKMQRTQNRALVKKTISPTVALVYAFVLGVMGFSILWFGVNGYAFLFAMIGFIVYVGFYSLWTKRTSIHQTVIGSISGASPPVIGYTAVTHQFDVAALLLFLAYALWQMPHSWAIAIYRFDDYKNAGIPILPVARSIYRTKIECVIYILLFAAVLNGLYCFGYTNVFFLITFNALTAYWFYLSIIGFKAENDQLWAKRFFLYSVILITLLSLSFSFTYQSPAPNLPLF

SEQ ID NO: 7075 - protein, 80 aa, Acinetobacter baumannii
VCMMDQQTLLQELNSLIEYYSKRTDCPPTRIRIGYRAYAKLMQCPPFADEVINSALDPNKRKYKKIKIKITKDDDQLEIE

SEQ ID NO: 7076 - protein, 871 aa, Acinetobacter baumannii
GIKMNIAAQPPVQADQTVYLKDYQKPTFLVESINLDIQVYDDKTIVDSTLVMKRQTAGDLVLLGRDLELQSIQLNGQDLTPAQYSLDSEQLVITDAPDEVILQTQVIIHPETNTQLEGLYKAGDLFVTQNEPEGFRKITFYPDRPDVLSVFTTRVEADKKYPVLLANGNLLETGEVGENRHFAIWQDPTKKPSYLFACVIGDLAVLKDRYTTSEGRDVALEIYAIEKDIPKCHIAMEALKHSMRWDEEHYGRAYDLDNYMIVAVSQFNMGAMENKGLNIFNTSCVLADEEYTTDAAIMRVQSVIAHEYFHNWTGNRITCRDWFQLCLKEGLTVFRDQSFSEDLQSAAVQRIDDVAVLKSHQFPEDAGPLSHPPRPDHFVEINNFYTATVYEKGAEINRMMSTLLGKEKFRQGTDEYFRRHDGQAVTVEDWVAALSAGSGVDLSAFLTWYNQPGTPKLEAKGEYDAAAQTYRLSFKQSLKAHPKYPNLKAVPIPVALALFNAKTGEQYTLQSESLFVNGVKDGVYLFDQDEATIEFTGVTEQPVVSLLRNFSAPVNLVFDYSDEELAFLIQHETNGFNQWQATQTLLERILLEDHSADTYIQAIQSTLPELVGRDPLLASRLFDVPTEGYLGSRIDQNYAPADIHVKREALLNRLAQELGSFWKDTYLTLDPDLQKEFSLAMGVRALKNIMLMMMARQGDQSAFELAYEQYQSTGNMSERLGALRVLVWQSAPQAQEALADFYNRFKDEALSLDQWFMIQAANPNATVETIEYLTQHPDYDLTTPNRIRAVSGGLSNNPENTWGFGVAHFINLAEYLDEKNPILGSRLLQVLSRWYTLAEPQRTQVQQALQALQPKVKSKNVSETLNSMLSV

SEQ ID NO: 7077 - protein, 308 aa, Acinetobacter baumannii
LGWIYSIFTPEVEKQLISQIFFAFEDKMSRQFDHLADVEVFLIVAEKLSISAAAIDLSTTPSVISRTITRLEKKLGIQFFRRTTRHLSLTEAGQLYYEKMQHAFQLIDHAERVVQGEQLHISGKIKLSVPTTYGHYRLPPLLEKFLLKYPDIQIEISISNRNVDLIAEGFDLAIRQGQLPNSTLIARPLEQAPLKLVASPAYLKRMGIPKNLEELKHHQCIAFELPSSGKITPWFLKNDNEEIQWIPTNRILVKEDIVGVVTLAESGLGICQSYDFIVNEKIQQGKTTTYTYYICRSYTSFFFVICAA

SEQ ID NO: 7078 - protein, 349 aa, Acinetobacter baumannii
TCYLSRGIFAMNIKTKKLLRHLCMFSGLMLTGNMAHAACSVSASGTSSISVPSIYLMENGENSSQFNSGLSCTGFSLALANMTYLKYRVEQMSNSFTNAQTGEKLNAIILDSNNEIISLGQEKDMSSFTLVNLFSGPDGNLPFYIRLPAGQSVSPGVYRADSPLKVKWFYSVPAVAIVGIGAFFESPGFKRGVLGIGFNWGSGADSLGSLSITVLPDCRILAQDVNFGTAAFASKLEPVQSSMGIRCSVNTPYYVSLNNGLSPQNGNQRAMKSQTGNTFLKYDIFKNSSNDRWGSGNERWSSLNATINPGVHNGVTQQNYVFTTKIVEENADTIPAGTYQDTVTVQVEF

SEQ ID NO: 7079 - protein, 289 aa, Acinetobacter baumannii
LLNLVKSFVQVRSLVRKSWIVHLWQNGIKNKQVETAMASATPDKIRDCAVVIGVGASQGIGAAVCHRFAKEGLKVYVAGRTFQKIEAVAAEIHANAGEAVAFRLDAEDINQVQALFDTIISQNERITAVIHNVGGNIPSIFLRSPLSFFTQMWQSTFLSAYLVSQSCLKIFKEQNHGTLIFTGASASLRGKPFFAAFTMGKSALRTYALNLAQIYKTQGIHIAHVIIDGMVDGDRINKALFGLGRFIRLTQGTGGLNINALADNYWMLYQQSPELWTNELDLRPYQEKF

SEQ ID NO: 7080 - protein, 173 aa, Acinetobacter baumannii
EINVMSFPQVELNTNKGRIVLELNTEKAPKTAANFLEYVRDGFYDGVIFHRVIDGFMIQGGGFDENFKEKATRDAIENEADNGLSNDVGTIAMARTQAPHSASAQFFINVKNNSFLNHTSKTAQGWGYAVFGKVVEGMDVVEAIKGVRTGNRGYHADVPLENVVIESAKIISE

SEQ ID NO: 7081 - protein, 383 aa, Acinetobacter baumannii
NKDVEMILNAEQSMVQEMMRNYAQNQLKPTAAHRDKTHEFPAQELKDLGALGAMGMTVPDEWGGAGMDYVSLVLAIEEIAAGDGAISTIVSVQNSLICGITLAYGSEQQKQTYLPKFASGEWLGCFCLTEPHVGSDASAILCKAERDGDHWVLNGVKQFITSGKNAQVALVFAVTDKQAGKKGISCFLVPTNTQGYLVTRIEDKMGQHASDTATITLEDCRIPLENLVGQEGEGYKIALSNLAAGRIGIAAQSVGMARAAFDAAVQYANERKAFGVELVQHQAVGFRLADMATQIEAAHQLVLHAATLKDAGLPCLKEASMAKLFASTMAERVCSDAIQIHGGYGYVSDFPVERIYRDVRVSQIYEGASDIQRLVIAREVAQV

SEQ ID NO: 7082 - protein, 304 aa, Acinetobacter baumannii
VLFVKWLQIHITVDQEQVEFTETLLMSLGAVSVTLDDAEDQALLEPLPGETPLWNKVIVTGIYQQDEQDPIDVDTLEAFLKAQLPDVPMRHEELEDQVWERAWMDYYEPIQIGEKFWIVPEWLEPPEADATNIKLDPGLAFGTGNHASTFLCLQWLGKTDVKDKIVIDYGCGSGILGVAALLLGAKKVYATDIDPQAVLATKQNAELNGVLDRLYVGLPEEFDQEFKPQQADVLVANILAGPLMALAPEFAKLLKSDGDFALAGVIEEQVADVSGVYSEFFDILDVEKREENWCRISGKRKTTN

SEQ ID NO: 7083 - protein, 190 aa, Acinetobacter baumannii
FLFLSSLNMKNIGLAILAISLSGCAAMSVKECKTANWSLVGEKDGSKGSSPRLDQYYKACGKANIVPDQKSYERGYKEGLGYYCQPSNIFYNALEGNGNINVCPIEQRNRLRPYYRAASDYYNAKAEYERYDEKFKQYSDSAYNEKLKPEERERYHKLLRELQIDRDRINRNYWNSIRDIERFKYDHGLK

SEQ ID NO: 7084 - protein, 149 aa, Acinetobacter baumannii
SVDVILLQRIKNLGKLGDKVSVKAGYGRNFLIPQGKAVAATEANTAAFEARRAELEKQEAEVLAAAQARAEQLNEVNIVITAKAGDEGKLFGSIGTRDIADALTNAGLTVDRAEVRLPNGALRHTGEFNIAIQLHHDVVAEVLVTIVSE

SEQ ID NO: 7085 - protein, 238 aa, Acinetobacter baumannii
RESFMLLEKILQSQGFGSRKYCQQLIKNGSVSIDGEVVSDLKKQFSPENFEFSVFGQNYQYREKIYIALRKPQGFECSHHPQHHQSVFSLLPETMIHRGVQAVGRLDQDTTGLLLLTDDGKYLQALTHPRKHVPKVYHVTTYDPVTPEQIEMLTQGVNLHQEKGVFAATDVALLGTHQLTMTIHQGVYHQVKRMIAAVGNKVEKLHRHQIGQLVLPEIEEGGWIYLSEQEKQLAQNII

SEQ ID NO: 7086 - protein, 242 aa, Acinetobacter baumannii
DKAVTYLFISDLHLSPEHPRLVRGFLDLLVHYQNKQTQLYILGDWFNAWIGDDYSAPWLDEIVEALKVFNQKGNRVYFQVGNRDFALNQVFLDKFNGVLLPDIYYLNIAGHQYRLEHGDALCTDDISYQRFKKIIRNPFLVAFLRRTPLSFRTKLVNGFRKRSHSDKQQKSYEIMDVNEQAVLSALTDVDILIHGHTHRPAIHQLQHKQRIVLGDWREDQAYILEIDPSSNTQQLELIVWNY

SEQ ID NO: 7087 - protein, 429 aa, Acinetobacter baumannii
KPKVKTKTLGFLFLHQTKRQSHLSAMQLCIIGQSVVIDLNARSKMALQILQKQLDESSHCPLCQASMYWVDAEQFEQDVQFHECSHCQHRVFKDTKMTCHCDQCTKQRKKLLQQTRLQEQRQFKSKDQPQRSLEQLSFLNKLFLLSLLDDYARDDVAHDEYIHWDQIKYQPITPNWMFQNHLIKQLHKDGILNAQDQTDEPQCFYLNIRLDGYSDPSLFSVAQQLRHWFYENLSLGIPFRSADEVKDVLFQVLYQEIIQFTQFYCRTWGIQIAGSSNFQAFCYRLMDSLAIGQIYYLIQTALEYLYKQKALQPRNEKFINTNLLKKTLEQYRERALAEKWETSMLPRPYNIPYSKMSHILFNRFLGYDEQIFVQPVWKAWRKIEPRLNFYSVKRCMYCGSNDLSVDYDAADYVSLICQNCKHQDHYFTR

SEQ ID NO: 7088 - protein, 188 aa, Acinetobacter baumannii
MAKVVTGLRPGGRSERIQTAVHQAVKELQKDFEQSQITIPMIAVQAGVTPSTIYRRWGDINQLFSDVALNELKPDMEPKDLGSFQQDITAWVEQYFEEYASEVGQDLLRDVLYTSNSDSNARKCETLIIQQLDIIQNRAKLRNELTIPNQEIIEAVIAPMLFRILFTNHDLSLEYVYDLLNRLFIKNK

SEQ ID NO: 7089 - protein, 419 aa, Acinetobacter baumannii
GEKVMKVLLDILFAFAFLYPLLMAWTWMVGGLWFFFKREYHEQQLPEPSSEGCSIIIPCFNEEAQVRQTIRYALQTKYPNFEVIAVNDGSSDSTAEILDELAAQDARLRVVHLAENQGKAVALRSGVLVSKYEYLVCIDGDALLHPHAVLWLMQPFLNFPRIGAVTGNPRILNRSSILGKLQVGEFSSIIGLIKRAQRTYGRIFTVSGVIAAFRKTALVRVGFWSDDKITEDIDISWKLQMDHWDIQYIPQALCYIYMPETFKGLWKQRLRWAQGGVEVLLEYIPKMFKLRLRRMWPVMLEALISIIWSYVMIMIFILFFVGLFVDLPQQFQINSLMPQWYGVILGGTCLVQFLVSLWIDHRYDRGRLFRNYFWVIWYPLFFWLLTLFTSVVAVPKTIFNTKKRARWVSPDRGFRGDHS

SEQ ID NO: 7090 - protein, 61 aa, Acinetobacter baumannii
NVPVLNVQTSSRDSSFLLFWSLFPYTFFFEFPFINLLWRHPNPLLLPLDITHSSWQFFLSQ

SEQ ID NO: 7091 - protein, 182 aa, Acinetobacter baumannii
CKKVLTMKKTFFYLSAFAVGLSSLNAANAATATGTLTVRATVTNSCVLNTSATGTTANAVLDFGTLSSLAGNVDADTTTTGGTPIRVLCNNTVPWTLSFDGGQNVLSTQRRMIGGASTTEYIPYNLYSDTGRATAIGVATTAYSGTGTGNVQTVNVYGRIPAGTTLPSAGSYVDTVTVTVTY

SEQ ID NO: 7092 - protein, 308 aa, Acinetobacter baumannii
VHLFLMSKNLATLIGLSAILMWASMVGFVKHITTAIGPDVGITLIYSLSALLLLIIFRVPNFKLISKKYLILGAILFIAYELCFSFALAYSKTAQQAIEVSIVNYLWPSLTVLAFVIFRELKFNVFIILGLLISISGIIFIQTGNGDFSLGRVVDNFHSNPLSYILAFIGAIIWAFYCVLTKKMGKGQNPISIFFLGVALTLWLKLLFSGQVSLPSLDLNTILSLIVASAAIGLGYAAWNIGIIHGNITMLVVASYFTPIISSLLAMLVLQTELSISFWQGTAMVTAGSLICWLSTNWAVIRSYFRKN

SEQ ID NO: 7093 - protein, 308 aa, Acinetobacter baumannii
KSILKLPAVHLCFLKFRLIGSLQMVLIFAAALCSVLVSVLLKNLKKKGYQPMQMIAWNYASASLLCYLWFKPDIQHISIQHTPWWLIVALGVILPSIFLCLAKSLEYAGIVKTEIAQRLSVVLSLLAAYFFFQEQFNSLKLLGIGLGIFAVLLILLGHFNESSGSQSKKAIFALMSVWFGYAAVDILLKYTSSLGLQFTLTLNLIFITAFVLSIIYLIFQKNSAWHFKNTFAGLMLGVLNFSNIALYVKAHILLKDSPAIVFASMNILVVLLGIVCGVVLYKEKLKLPTIVGIILGISGLVSLALAMK

SEQ ID NO: 7094 - protein, 314 aa, Acinetobacter baumannii
IYVFRLVPMLEIRHLKTLVALREHGSLVAAANDLCLTPSAISHQLKELDHWYGVEVVNRRSRPVSFSNVGQRLLKLADDVLPQIQITQSDITRIVHGQTGRIIFSSECHSCFDWLMPLLNQYRQQYPDVDLDFASGFEANPHELLQNAEFDLLITADPIALKGIEYFPIFEYESRLVLSNTHRLVRAENITVQDLAEEVLITYPVDKHRLDIMSKLFIPANIQPKQIRTTDLTQMLIQLVASGRGIAALPDWVVNEYEQKGWVTSRRLDCVSPAGLRRTLYAGYRTEEKEKSYFEGFLKQLEKFSLKRTSYYSG

SEQ ID NO: 7095 - protein, 775 aa, Acinetobacter baumannii
LKSFSFIIRRIYNHSQGEKMGNKIKSNKLFTRKSEAKNIIPLLSLGGAIFLSNSAFAASPSETTDAEKKPEALPTITITASRADELSTSAKQVTKLDEKQIELLRNGSSGNIATVLAKAVPGLSDSSRTITDYGQTLRGRNALILVDGVPMNLTRDTSRGLSAIDPESIANIEVIRGSNAIYGGGASGGIISITTKAAGGKPTAKTVVGLQTPLTNFRSNALSGDIHQYFTGSFNAFDYALDFGYQRIGSPYDASGDRVAPEPSQGDLYDSDGYSIGGKLGYHIDDNQYLQFAANYYNAEQDSDYASDPSVKNAPAGTVPAKAIKGLKLKDQNKNENQIYNLTYNHKDFFGNKVDAQIYYRDFFTRFSPFDARKNANRGGQVDQIYQENNVLGSRLTVTTPLEFLGDTSLVWGGDFSREKSEMPLDIFDQKIYDQSGGLEFVKIGKLIYLPELTTQSVGGFVQLKHRFNDQWSAEAGTRYEDSYAQIDSFIPLSQFDPKTQSYKPNPYVYQGGKVKADAWLYNANVTFSPNDQHSIYASFNQGFQLPDVGVIIRNADNTDKEKNYELSSSFLEPVKVDNYELGWKGNFNNFSSSLAVFHSTSDLGAVQSFSNGLALTRTKEKVTGVEATFDYLDDANVWGTGGSVTWMKGREKPQNGAEQDMTGFRIPPLKLTGYISYSPTETWTNRLQATYFGSEDYRLNGKNSFGRYDVKSYTTADLISSFALNKKDTMTIGLENMFNRKYYPLYSQLLRTSDNTSHLVANSVTLKVTYSHKW

SEQ ID NO: 7096 - protein, 287 aa, Acinetobacter baumannii
ITPLRLNVNYVNWLKGGYVNGWDDPRMPTVVSMRRRGFTPEGLRDFCKRVGVSKTDGIVDVAMLEFCIRQSLENTAARGMAVLNPLKVTLTNLPEDLDLTHARHPNVDMGERVIPLTKEIYIDRKDFEEVPPKGFKRLIPDGEVRLRHAYVIKCDEVIKDANGEVIELKCSIDPDTLGKNPEGRKVKGVIHWVSATKGIPAEVRIYDRLFTEADPETGDDFLANLNPDSLKVVQAVIEPALAQAKPEDRFQFEREGYFVADQYDHTPEKPVFNRVLDLKDSFKPEKK

SEQ ID NO: 7097 - protein, 359 aa, Acinetobacter baumannii
LIQLIKYFIGRYSGEFTYVSLIYVQYNVVQIRMRILAWKTVRRFFYNNLHNHDYETAVSRCINYFLVFLIIGNVVAVLLETVNDLYYSYRIWFDYFENVSIAIFSVEYLLRLWSIVERDPTQAAWKQRLAWMKSGEALIDLMAILPAYLNFFVRIDLRMLRILRLLRLLKLTRYFISLQILLCVIKREKGSFQAVIFILIIMIIMTASGIYVVENKAQPEAFSSIPKAMWWAVVTLTTVGYGDVTPVTSLGKLLGALITILGVGIAALPAGILASGLANELNQRNQRLEQEFRELLQVRGIDIMHDEVEIERIRQKVGLPKEQAHNLIIQIMREKVLEEKEAVREKKCYCPHCGEKLTD

SEQ ID NO: 7098 - protein, 304 aa, Acinetobacter baumannii
QYKFLEKFVDDHHLKRKVGTLEMVVAMLLSGSIGLFVIKSGQSPVNIVFFRCLISALCLIPICYFYGHFRKVYFGKKELFLMVTSGLLIIFNWVLLFAAFPKTSISLATIVYHVNPFVILFLGALVFHEKLNKNDVLWTIIAFIGLIVIIGLGSASVNSNELVGLGLVLIATTLYSISVLITKKLSNTPPLLIVFIQTLSGAIVMAPFISVFENPPIGQQWLFVVGLGVLHTAFLYYLMYSAIKKIPLNNIAILSFIYPISTIVIDYFFFDHVLTSTQVLGAGLILLGVLGVKLHWNIFALKSA

SEQ ID NO: 7099 - protein, 389 aa, Acinetobacter baumannii
KAFSKKVEQAPANESLINNLARVERWREKPLEAKKTISRLNGIDPIAKDTRINEMQNAQALGDIPTWRKTTQNLVQYYPDDSGVIKSRKELEDRNRATISHSTTWGQSKADGRDTVSGQNGLKDREMETRLNSPWINDNYRLFAWHQDRYGEYRFGDVHDQRYGVGAEWQANRKALSAIVSQSTDGGQAGVRLDWSQWLNDHWQYQLQYNSQADIPLQALDEGEDGQSYRAAVTWQKDESRQIGASYGLTDISDGNKQQEFSTFWRERLFDAPHHITYGTIRGFYGTNSQDQTAYFSPSSHYSAELNLSHDWVTWREYERSFKQHFEAGVGLYKQADYSAKPTYSLQYQHQWQLSRTWQLNYGIGWQYHPYDGHDEQHTYGIFGFEGRF

SEQ ID NO: 7100 - protein, 141 aa, Acinetobacter baumannii
MMKLNALLCSAVLATSMVTVAHADNTTHVAAASALGSIAGTAIGKSMGGTSGATIGAALGGAGGAAVASDRRHRTESAIGGGLGGGAGYTVGKSMGGTNGGYIGAALGAAGGSALGNKISKDRDADHSSKYWKKKHRHHRH

SEQ ID NO: 7101 - protein, 144 aa, Acinetobacter baumannii
LLASNFIRGCLNRKELTMRHYEIVLLVHPDQSDQVVGMVERYISQIKEADGQIHRLEDWGRRQLAYPINKIHKAHYILMNVECGQSTLDELEELFRYNDAIIRNLIIRREHAITEESLLAKSAEEKRARKAQREEAQQVAQEAE

SEQ ID NO: 7102 - protein, 257 aa, Acinetobacter baumannii
NREFLLMQIYLARNNQQAGPYTLEQLNQMLASQQVLLTDLAWHEGMTEWKALGELTQGKLVYQPTGYSAFSANTNTPYNETIQHIRVETKTHELASISSRALAKIIDLLLWLPIAAIPSFFFNEAQYKQLFELQKQMQSAEVASTKAAELQQQLFTLIPIEAWHTMLLYVVIMLAIQAFLLTKFGQSIGKKIVGIRIVDAETNGKVNLTRIFLLRSVVFIILNLLFMPISTIIDYAFALGQKRQALHDKIARTKVIK

SEQ ID NO: 7103 - protein, 72 aa, Acinetobacter baumannii
IVASFKFDKLLPTETHESLFEQIFDSLIKTFVLAKVNLSKLDVELFVEESKQGSVIFLPFTTKQLLLTSNGT

SEQ ID NO: 7104 - protein, 124 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTSSTTGGRGLRAMRI

SEQ ID NO: 7105 - protein, 159 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTFPDLDQTMNVSHTTIYSTIRALPKGELKKDLVSCLSSTTSAKDPRKGLT

SEQ ID NO: 7106 - protein, 723 aa, Acinetobacter baumannii
SYLKIMQRTTKHFQINALALAIAMSTISAHAETDQQTSEYGTLPTIKVKAGSGEENEKSYIAGKTETAVPLGLSVREVPQSVSVITQQRLQDQQLSTLVEVAENVTGVSVNRYETNRGGIYSRGFVVDNYIIDGIPTTYSLPWSSGEIFSSMALYDHIDIVRGATGLTFGAGNPSAAINMVRKRATSTEPTANVEVSAGSWDNYRVMGDIANSLNQSGTVRGRAVAQYEQGDSYTDLLSKEKLSLLLSAEADLSENTLLSGGVTYQEDDPRGPMWGGLPVWFSDGTKTNWSKNTTTSADWTRWNVKYTNLFADLTHKFNDNWSAKLSYSYGKRDANSKLLYVSGSVDKNTGLGLSPYASAYDLEVEQDNASLQLNGSFDLWGLEQKVVLGYQYSNQDFTAYARSTDTKMEIGNFFEWNGSMPEPVWNAPTLNEKYNIEQNALFAATYLNPIEPLKFILGGRFTNYEKNIYGRSSSIKYDHEFVPYAGVIYDFNDVYTAYASYTSIFQPQDNKDFDGNYLDPVEGNSTEVGLKSAWFDGRLNGTLALYHIKQDNLAQEAGDVTRNGVKEIYYRAAKGATSEGFEVEVSGQITPDWNITAGYSQLSAKDANDADVNTQLPRKMIQTFTTYKLPGKLENITVGGGVNWQSSTYVNAKNPKKVIEKVEQGDYALVNLMARYQITKDFSAQLNINNVFDKKYYGVFPAYGQITLGAPRNAALTLQYKF

SEQ ID NO: 7107 - protein, 347 aa, Acinetobacter baumannii
DGIKMKIKLSKIVIASSLLIFANMSYAEGVKRFSVSAGWLHVMPQGKANPFNINTSVKNGTVAKVGSISPTSFLNSVDPNATEVDVGGEPFNQKEFLELALNDDFLKGLLLDEEGNIKPEVAGEATIQGLEQWHQNDAGLEVDDTDTLGLMFNYYLNDNVSLQFIGGIPPKVDIKGQGEILAPLSGVALSPNELVKILFPNGITLGQAVPITNLGNKPKAASVRAWTPAIEAQYQFGKSGVNKFRPYLGVGLMYAHFNDIKLNDEIRSDLISAGHMIQNVLDGKAGAALDRKESSGNMVVKVDADDAIAPIFTAGFTYDFNDSWYTVASVSYAKLNNRTQIDGQSKT

SEQ ID NO: 7108 - protein, 144 aa, Acinetobacter baumannii
IFIGSFRLDVDYIERKNMKRLIILFLLAYATSSFAQVPFEVSKSCFVVNGRNITEPCLLSSTNNSTSNFERLTFANTKVFIKESNICSNNDSCVSVGSNLSNLKDATIYYRDLKTKKIIEKPEKDSWTCFKQPIDKLDFCISYN

SEQ ID NO: 7109 - protein, 175 aa, Acinetobacter baumannii
EKRIKLKMNIFIRDEREEDIKEIEELTKAAFLNAEHTSHTEHFIVNNLRKHKQLTVSLVAVEDNTIVGHVAISPVQISSGEKNWYGLGPISVAPNKQGQGIGSLLMNSSLEKLKKLGAKGCVLLGDPKYYSRFGFKAYPDLKLHGVPPEYFQALSFQNYVPKGDVSYHEAFNAQE

SEQ ID NO: 7110 - protein, 72 aa, Acinetobacter baumannii
IARSNTMSFMIVSNNFAVPYYLNVRKEKGMTAYYWATHQSQLALFDSYELAYRFYFPSRHILIRSEIKAFAQ

SEQ ID NO: 7111 - protein, 71 aa, Acinetobacter baumannii
KRHPVCLIIYMHIIIGLNRLQSMFRVAEFIRIKHNHSCLFSNYGLSVHSEISLINSNYLEFRLKKTKLNET

SEQ ID NO: 7112 - protein, 272 aa, Acinetobacter baumannii
ALFTGEKLMGTLKHPLVEDRMISGEGTPEFMWLEAFKKNPLDRLNLKLFQSKRVVIVAPHPDDEVLGCGGLMQQLVEQNCHIVILAVSNGTQSHPHSVKYTPDQLNDLRPQETLAALNTLGISAFSERIGLNLMDGQIHLQTDQLNQALSQIVQPEDILICSYALDGHPDHEAVGKTVQAFAEARDLLCLHVLIWAWHWAEPFDTRINWSKAKAYALTENQLIKKHQAVMQFKTQLEADESTGNSAVLSSSAISRLLMPYEVYLSDSFSCVF

SEQ ID NO: 7113 - protein, 229 aa, Acinetobacter baumannii
  UNSURE (226): Identity of amino acid sequences at the above locations are unknown.
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTFPDLDQTMNVSHTTIYSTIRALPKGELKKDLLSCLRHENKKRKANGEPKKDSILQDIKTIHERPAEVQERKIPGHWEADLIKGKDNKSSIATLIERNTPLCSCITRAAPDPTYTLXKGE

SEQ ID NO: 7114 - protein, 526 aa, Acinetobacter baumannii
GVTTMTNGLEDFSYDEVSTENSTHSEQAKKVLGHFIQGRIVSKTARKQPVYNPATGEISKEVEIADAQTVNEAVQAAEQAFPAWRDTPVIKRARVMFKFKQLLEQNAEKICALIGQEHGKISHDAQGELQRGIENVEYACGAPELLKGEFSKNVGPDIDSWSEFQPLGVVAGITPFNFPAMVALWMFPMALVCGNCFILKPSEKAPSVVLYLAELLKQAGLPDGVFNVVNGDKEAVDGLLHHPRIQAVSFVGSTPIAEYIYRTATSTGKRCQALGGAKNHAIIMPDADIDNVVTSLLGAAFGSSGERCMALSVAVAIGDEVADVVIDKLTQEMKKLKFGNYADASNDFGPLITQAHKDKVQAYIQSAEQQGAKIVVDGRDAKPAGYEKGFFVGPTLIDQVTPNMTSYQQEIFGPVLQVMRVNSMQEAMQLINDHEYGNGTCIYTRDGEAARYFSSHIQVGMVGINVPLPVPVAYHSFGGWKRSLFGDLHAYGPDGVRFYTRRKTITQRWPSAQVREAKQFSMPTLN

SEQ ID NO: 7115 - protein, 419 aa, Acinetobacter baumannii
ECNQKVVYMEFVFNGFYTLISAVIVLLLGRFLVNRIDFLKRYNIPEPVAGGLVAAVVSLLVHTFWGYSIVFSSELQTSFMLVFFASIGLSANFMKLKEGGTALVIFLICVASFIVVQNAVGMSLATLLGLDPLIGLIAGSITLTGGHGTAGAWGEILESQHGIQGALALGMASATFGLIIGGVIGGPLAKLLINRYSLAQAKTNAEIQQRDTHVEQNSDDLAPFENPHQVRLITADNAITTLGMFAACLAFAEFMTGFSKGTWFELPTFVWALGGGVILRNILESVLKVDIFDRAIDVFGNASLSLYLAMALLSLKLWQLADLAGPLVVILGAQTLTMALYAAFVTFRVMGKNYDAAVLAAGHCGFGMGATPTAVANMQAITNMYGPSHKAFLIVPLCGAFFVDLINATVIQLMLKFIA

SEQ ID NO: 7116 - protein, 305 aa, Acinetobacter baumannii
MKPKKLNQVTDFDIKLLKIFKTVCDCHSFTSAESILGISRSAISLHMSDLENRLGIRLCQRGRAGFALTDEGREILEYIEVLTAAIEDFRSKVNQMHNRLKGEFNIGIINNLVTMPRGYITNTLTQLAEEHAEVIINISMSTLSDIECRVLDNRLHAGVIPLVTPLSGLEYFDLYSESSFLYCGKNHPLFSQCSNMNLDELKTWQAVLPNYAITPEAAKLHQLLDCKATASDREGIAFLILTGKFLGFLPDHYAKKWVEDGFMQAVSKEKMHYSTPICLITHKGKNHNNILKTFMEMLEKRIANN

SEQ ID NO: 7117 - protein, 466 aa, Acinetobacter baumannii
NMNNDRTKKLGEGLSNRHITMISIGGVIGAGLFVGSSSAIAKAGPAVILAYLITSIMVFLVMRMLGEMAVLEPDTGSFSTYARKAIGPWAGFTIGWLYWWFWVLAIPVEAIAGAEILHSWFPSVSVSIYAFCFIVFLSLANFFSTKSFGEFEFWFSLVKVVAIIGFIIIGILAISGIWPLAKNVSGVANLYNNAGFMPHGMGGILSAILITAFSFFGVEIVSIAAAESSNPKQKIRRATNLVLYRIILFFVVSMFIAVSLVDWRSPDLQKYGTFQYVLMSLNVPGTKLIIDTVVFIAVASCMNAAIYTSSRMLFRLGTRNEAPQAVTKVNYAGVPAIAVFSSTFIGLVCCVINYVFPGKVFGLLLSSTGSIALLVYLVIAFSQLRLRYKLEAAGAEIPFKMWLFPWLTWFVIIIILSVLAYMFFSPAYSYETTLSLGVTLGVVVCGLFVTRKRKATRSVAINQSNL

SEQ ID NO: 7118 - protein, 225 aa, Acinetobacter baumannii
SFINSSARTITMKIGVVVPAHNEEQHLPACLQSIQEAIEKVPDEQVEVMVVLDSCTDQSRSIVQRYGVSWIECNYACVGKARDLGIRQLIQNGATWLACTDADSVVSPDWLRCQILHQPTDAICGIVTLDDLSRLSVMKQKKYLSHYQDCMDHHHIHGANLSFSAAAYMQVGGFEPVPCHEDVSLIQKLIRQCCNITWSNLVRVTTSSRLEGRAPEGLSKFLENL

SEQ ID NO: 7119 - protein, 324 aa, Acinetobacter baumannii
TYSDTIILCLIVQFLFHAFLKVELMELSQTISNLIFEIQKLTQAVEKISKTQEISVDVLDEAIAFRWERENNKGSLVAIRKPQLISFNHLCNIDSQLNKVKLNTEAFAKGLLANNVLMTGSRGTGKSSIVKACLNEYHHLGLRVIELEKKYLEDLPKIINLLQDRTERFIIFCDDLAFEAGDSSYATLKTVLDGSLASSSDNTLIYATSNRKHMVTEYNKDNTELNVGENGELRPGDSIEQKISLADRFGLQINFYGFSQQEYLKTVQYWLNEYKWQQRETWETIQLKAIQYATQQGNRSGRIANQFAKMIVGQEMLSAADLTV

SEQ ID NO: 7120 - protein, 323 aa, Acinetobacter baumannii
KTSLLNLRLVLMHTKFLKFLHKSSRTNFSSFILFQGLKLKVYRLVLMSNWVDISKDTNTGIETIRAHFTGHAYDPHWHSSYLIGVTESGIQQFHCRKKQINSHAGQVFMLEPEEIHDGHAPASDGFTYQMLYLHPEWLKQRLQGLFHNSPDHYELVIDAPLKSDEQLAIITSQAFRHLHYKEMNIVKDNSLDVLIQYIAQGKWLKKVSQSSCIHFPHIAHQIRDILHDHLFEDIGLEDISRMVGLDRYHIHRIFKSTFHLAPHQYLIQLRLTRARDLLARSISPAQVASDLCFSDQSHLSRWFKRCYGLTPAAYRKICTNLQD

SEQ ID NO: 7121 - protein, 131 aa, Acinetobacter baumannii
IAIDKITRRTFMKKILFTTLTGLVLLTSSAAFARTDPALLNQAAKNVVTVSKAKTLADETGVTLTGTIVKHIAGDHYEFKDKTGSIVIDVDDDLANGWQLKVGDKVRIVGEIDTHRVKPTDIEVLQIERVK

SEQ ID NO: 7122 - protein, 238 aa, Acinetobacter baumannii
TLLWTNTSRLQKNLHKSSRLKILIISSCLFQLTKVDKMENLTAFSLFAIVASITPGPTNFIILSLSSHYKISKTLPVILGSCIGAALLVLVVGIGLGSTILAYPVIQKIMAWSGLIWLTVLAWKLYNYNPVISLEKNEQYPPIGFKAAFLMQAINPKTWMMAFAVISVYTKQGQDILVNVSILSCIFLLIAFPCLYLWALVGRLSTRLLSKPKHINIFNKIMAIILLASVWWPMFPRF

SEQ ID NO: 7123 - protein, 109 aa, Acinetobacter baumannii
RMFIAKNIFVYLLSMLALCLLIILFNYLGMNQTLNLIISSALFGIFITWYYKGSGLCIALFSFFYWAMFVISQSLEVIWMLSISVIVYLVMTQIVPKLKHIHIGIASNS

SEQ ID NO: 7124 - protein, 123 aa, Acinetobacter baumannii
QFYILHKPFKLIRWFMSHFKFYSAEQPIITNAFKEFFSISDHLPYVYEALSIIQKYNLELIYKIILPIHNKISSEEYKERAIIIITQLNGYLVQHSNKNTDENYKEFLRSILLKNILRLVSEP

SEQ ID NO: 7125 - protein, 247 aa, Acinetobacter baumannii
DDSITVCLSLLVPILMIEQIQKRSLVDEVIHVIRQNIKNDIWKVDEKIPTEPELVQGLGVGRNTIREAIKILEYLGVLEVKQGLGTFVRTKNDFSIVINSIHHSDLYEHVEVRCLLEIEIAKLAARHSTPEDMRDVIACLEHRAATNQQDVANFMLSDKKLHLAIAKATHNKALQATYEYFLNSSYQYTLELVTNKNLPDPNQQIHSELVQAIQHKSESEAMRIAESMLAPILRSLDSIKADFVQNH

SEQ ID NO: 7126 - protein, 340 aa, Acinetobacter baumannii
LFVMNIKISINMTILSMLNEFEHAQAENKSQLRQDLLYQLVSLSKSLPYPASGHTYQRWQLFAQIAGYDLSLAKLFESHHDALSILNELGYQDEIDDQTWVVWAAEGGPAPIQVQNNHCNGIKTWCSGAEFIQKVLMSYKDKEGQAQLCIVDLAHPSVHVDLSHWQAVGMQGTQTAQVHFDNTPVIPIGLPNCYLERPGFWHGAAGVAACWYGAAVRLVSFLHKSCTLNPNAFKKMYLGELAQQLSVTKQYFQYIAKLIDDEPALSHEREIRILRAQTEQCCQSVIQLVGKALGARPYCEEPTFSQLIADLPVFIRQSHAAFDYESIAELCLPEKSLWEL

SEQ ID NO: 7127 - protein, 102 aa, Acinetobacter baumannii
KLRISAVLSSNLVSTVFLFPKKRSKMNTLNINDIKKHADVIASCGTKVGTVDHLEGENQLKLTKDENDQHHLIPTSWIGEVKEDQVILNKNSEEVKENWQAI

SEQ ID NO: 7128 - protein, 462 aa, Acinetobacter baumannii
TGMVMFDTDKFSDSEHTLEAVQTNNNMHINYQAHWMPFSANRNFAKDPRMIVGAKGSYLIDDSGREIFDSLSGLWTCGAGHTLPEIQQAVSAQLGQLDYSPAFQFGHPLSFKLADKIVQHMPEKLQHVFFTNSGSESADTSIKMARAYWRIKGKPSKTKLIGRARGYHGVNVAGTSLGGIGGNRKMFGQLMDVDHLPHTLQPDLTFTKGCAETGGVELANEMLKLIELHDASNIAAVIVEPISGSAGCIVPPTGYLQRLREICDQHDILLIFDEVITGFGRLGTWTAAEYFGVTPDILNFAKQVTNGAIPLGGVVASHEIYSAFMQQDLPEHAIEFTHGYTYSAHPVACAAALAALEVLEKKNLLAQSAALAPSFEKVLHGLKGAPHILDIRNCGLIGALQLAPRDGDATIRGFELGMKLWKEGFYVRFGGDTLQFGPMFNSTEADIDRLMNAVGDALYQVN

SEQ ID NO: 7129 - protein, 164 aa, Acinetobacter baumannii
NFIFHGSLMNVRLCYASQRNEKNEDLLQDLRDILTEARDFNDLNGICGVLYYADNAFFQCLEGEQEVVERLFEKIQKDQRHYNIKWLCTYSIDEHSFQRWSMKYVQRNTTIEAFFLNMGENTFNPLLLNQQNLKFFLNELLIAEQTKMNTVKKVGMVNRGVNPF

SEQ ID NO: 7130 - protein, 386 aa, Acinetobacter baumannii
VLYSMSLLLKVRQNVPQVQSIKTSLKKRAGQKIPHMLSNASDLFFRGSEIALSGKTPFDVIYKHEIISLRHYRNETEASAKHRVPLVIVPPLAVNMLIYDLFPTRSLIRYFLDQGFEVYLIDWGVPTRNQAKYNFGTYVKVFMPEMLKQVRIHSGQQQLSLHGWSLGGALSLCYTALFKDKDIKNLMILASPIDTHKAGYMGKLYGSLTKPAQWVRKHTPFRIRQHVPSEVFHIHGWQNTLGFKLTDPIGNLKTYWQLLKNLDNREFIVDHATSSSFIDNMLAYPGGVMRDIILRFWIDNELSTGVIKFGELTAYLKDIDCSVLAVGGDTDIIVTADAVKPLMDLISSQDKTFKTVPGGHMGVVSGSQAPTSVWPEMSNWLATRSD

SEQ ID NO: 7131 - protein, 199 aa, Acinetobacter baumannii
VIHSRVYFEELYRSNNDPWGYDYHWYEARKRQICLALLTRPHYERVLEIGCSNGHLSVYLAQRAARLLCIDVSKQAVQLASQRLEAFEHVTVENRKIPEDFYEQKFDLIVISEVAYYLTFDELGEFIEQLKQALNPEGEILCCHWRQDIQDFELNAQKVHQSFQQSFPFHHYLSLNDPDFMVDVWTVNPSSIAQREQLR

SEQ ID NO: 7132 - protein, 371 aa, Acinetobacter baumannii
KTGSRSNTMKEFLKAYVQTFKDIVSNSSVFTTLILSVILYSFFYPTAYKAERAESIPIVIVDEEQSLLTSQVIGQTANSPHVKIVDVTANFLEAEQMVREQKADGILLLPSNLTQSLRRGETGGIGLYLSTTNFLKTKEIGLGLATSIEATLKEYIERFGQRTHFQPALSIHQMPLFNTLSGYGSYIFPAVASLIIHQTIVLGLAMLVASYREQHEKITPIRFAGIFASIFTIGCLGSFYLFGFTLWFNDYPHGGNFVGLLVAVPIFISCVIGLGMLIGSLLDIPERAGHIIVFSSVPLFLLTGAAWPHQAMPEWLQWFAWCLPSTHAVQMFVQLNQMGVPLNVVAPKLIFLATIGVIFLITAYSRLKVSK

SEQ ID NO: 7133 - protein, 113 aa, Acinetobacter baumannii
LPRLYPIKLNLNSFIPKLSYKKVVCAVFSTIVLFCKFKLLLPLSIVEGLVVLPGTASPVNFRILPFILSAIFFAIVLIVNMAFGSPQNSNVLLELSEPFLKILEDIIVISRLA

SEQ ID NO: 7134 - protein, 230 aa, Acinetobacter baumannii
HVMSPRFNFLDYDHNLKYTGFDVNHNQCIIMTSKVNKSERTNMKVSKTQVKENRDKIVEKATQLFRSKGYDGVGIAELMSSAGFTHGGFYKHFSSKTDLVTITAKYGLEQVLKRIEGLNLTQFIQMYVSRTHRDNRDQGCTLTALSCDAARQPDEVKVEFEEGIEQLIEFIMNERAKQVSLETEELRKQAINILAQSVGAIALSRACPDQSNLSDEILESCRESLLKLTD

SEQ ID NO: 7135 - protein, 128 aa, Acinetobacter baumannii
FLMFAHILQLARFTTTGTAAALTHYSVAMLLFKKHVALQYANLCAFLLAYWVSYFGHRVFTFKAQHLTHRQTLPKFTLVAGLGFLFNESFLLLSSLYFNVPISTLVCTAIVLTSMVTFLLNRFFAFQH

SEQ ID NO: 7136 - protein, 275 aa, Acinetobacter baumannii
FCNPALWWNLDMAKVCYCADDFAMNAEISDAIIQLIEQGALQATSCMTQSDLWETAAAKLKPFSDRVDIGLHLNLTHAFASGNLVFPLPMLIVRAWSASLNRELITQCIEEQWDLFVSVLGKQPDFIDGHQHIHQFPFIRDILLQLLKEKKFTGWIRNLQQPINPPHYRFKTRMLSALGSNSLAKACQTYHFNQNGQFAGIYDFKLSNYGQLNQYWLANAKDHLLIMCHPALVQSNDQDPIQHARIQEYQYFSSAQFQLDCQQYGIQLTRLGAMQ

SEQ ID NO: 7137 - protein, 347 aa, Acinetobacter baumannii
IRAFTREFTYVDLKNSNYPRFNISSEINPTSIVPMKNQNSPEVITVNDQNFGSHGEHWNLLTSHPETDVPKWLGLALDAPVMPMGLCQNEDEMDQSFWLIQGPQGQKVTINQIIAVENQKPRALKTAFPSFDSPYQYNAQIERIITCDSATQAVLSLKLNKSTTIYAFDNLFSVNRCQYDKTQTYQVQFNAWAYELESVPAGETIVVDDPASIKHHRALNAILTEHNGIAPENLQELINEWQPKTKEDQEPVTVDFSKMVAYLYGENLGQEDEAWFQGNIVGKTSMSFMGAEYTLYDVTLVLEDNLPAILVRIATKNDLYKNFNIGEYIRGNIWIQANIYAKNSETN

SEQ ID NO: 7138 - protein, 327 aa, Acinetobacter baumannii
MTRPDSKSMNYQLLKTFSRQPIQFGRFLARLLAGLVNTLKITRTSKSIELNLRIALPYLTPQQRIAITEKAVRNELTSYFEFLSIWGSSNSKNISRIHRIEGEHFFHEALAAKKGVVLIVPHFGTWEVMNAWCAQFTSMTILYKPVKNADADRFVREARSREQANLVPTDESGVRQIFKALKQGETTVILPDHTPNVGGDMVNYFGVPLASSNLSAKLIQKTKAKALFLYAIRNENDGFTMHIEPMDEKIYEGTADDGTYVIHQAIEQLIYQYPEHYHWSYKRFKANPALDNIYNIDPTEALKIVDRLKAEALKTSTQPEPIQTSVM

SEQ ID NO: 7139 - protein, 145 aa, Acinetobacter baumannii
VVGPVIQTTSPSCHSICSLPPASSTSTELASRPRRMPLTAAAQAPVPHASVSPTPRSNTRKRTCLSSITCMKPALTRSGKRLCDSTCGPIPATSAVSTSGTIVTACGLPMLTTSILMFWSFANSRVYKASGSSATNGISFGRNFG

SEQ ID NO: 7140 - protein, 421 aa, Acinetobacter baumannii
NKDTFMSFTRINGVLHAEQCSLEQLAQQFGTPLYVYSKAAFEKHYLDMDRAFDFIDHQICFAVKSNSNIAVLNVLAKLGAGFDIVSGGELARVLKAGGDASKIVFSGLGKTEADIETSLNVGIACFNVESYAELDRIQKVAARLGKKAPISLRVNPDVDAKTHPYISTGLKENKFGIPSDAVYETYQYAASLPNLEIVGIDCHIGSQLTETKPFVDALDRVIVMIDELKKLGISLKHIDIGGGLGVCYKDETPPSVEEYANSMKPALEKLGLKVYMEPGRSISANAGVLLTKVDLLKPTTHRNFAIIDAAMNDLIRPALYEAWMDIQPVVPRTDTEEKTWDLVGAICETGDFIGKDRSLALQENDLLAVLGAGAYGFVMSSNYNTRGRAAEVMVSGEKSYLIRERETVESLWEKERLLPEE

SEQ ID NO: 7141 - protein, 333 aa, Acinetobacter baumannii
MGSTWGTTGMSLSYQPTCSIDALKARAQLYTQIRQFFAERGVMEVETPVVSQAGVTDVHLASVQALRHINGKLQTQYLQTSPEFAMKRLLASVVGPIYQICKVFRDDEHGRIHNSEFTMLEWYRPGLDLKALMHETADLLQTCLQHRFGEVRPFILSYKHAFQDRLDINPLQATLKQLKDTANRVGLNLDLGDDRLAYMDLLFSHFVEPSLGFDAPVFLTDFPPEMASLAKVKVDEDGEEVAARFEVYIEGLELANAYDELLDSDVLRSRFEADNAERVKQGLHVMPLDEHLLAALPHMPECSGIALGVDRLLMVATDQLKIEKVIAFPAEIA

SEQ ID NO: 7142 - protein, 74 aa, Acinetobacter baumannii
IYETLMLFMLENAIFNKNIFPFITIKSKKARFYARSYTAPYFLTRRYCIAGMGIILAQACGHPIYWCFFPGLFI

SEQ ID NO: 7143 - protein, 377 aa, Acinetobacter baumannii
NMFASILRELNYLRSNKWDLCMVTLIPAFIIFLFSSMFYAGKAEHLPIAIIDQDQSELSRNIGKYLSLNHTVDVKTITTSSSEAERLLNETKIWGYVFIPDGAEKRFVKAQDAQISIAFNQSFFSVGNTISSAMLVSTLNALADYAGQNYLANNIPYIDVPTAHVKISTLYNPSMSYEFYLEPFMVPAVLHLLLCCCVAFAIGQEIKRGTLTQWVNRESFIQGLLAKNLLYSFIFCFWTWLWMFWLVEIRGWFVAGSLSFLLAAQFLLYFSYALISSTVILATKNLSKTFGFIAVYGGSSLSFAGVTLPLNNAPIFTKFWSLIIPYTPYAKLQTEQWVIGSPLFISMSPFLILIGYCLIYFFLSCLLLKKLVQGATP

SEQ ID NO: 7144 - protein, 279 aa, Acinetobacter baumannii
AKGALNKRHFEVKEIILTPHAYGVETLPVQRFNKTESENVLDHIVQEYPIALVYNGISHTVMMATPTDVDLFAKGFSLSEGILTGLKELYALEVHQNELGITVEMTISSRAFAALKEHRRMMVGRTGCGLCGIESLKQFQLDVPKITTHASKIWLEQIPSAISHLKTQQEITALTGGAHAAAWVVDGQIVALFEDVGRHNALDKLLGYLAQENYDTSLGFVVMTSRASYELIRKCAQLNISLLASISAPTSMAIQLAKQSGLTLASFCRGDGFVLYTEI

SEQ ID NO: 7145 - protein, 268 aa, Acinetobacter baumannii
KIKAWRHHMSVQSKVLITGASSGIGSVYADRFAQRGYHLILVARDTNRLDKISKDLQEKYGVQVEFIQADLSNDQDICKIEEVLKNDADIEILVNNAGIALNGNFLTQDRNEIEKLLTLNMTAVVRLSHAMSQSLIRKGKGAIINLGSVLGLAPEFGSTIYGASKSFIQFFSQGLHLELKDHGVHVQAVLPSATKTEIWERSGIDLSQVPPLMDVNDLVDAALIGFDRKETITIPVLKDENQWNNFEKSRMTLLPNFSSAEVAQRYKN

SEQ ID NO: 7146 - protein, 122 aa, Acinetobacter baumannii
LNLYLKYLVALSFEQHLAVRPTRQQDEYMAQFAQNRYFPVCAFVLLNYPLFHPLIFLHSTGSVKSQFNYGFIKATRCLPMSRVHFLYYFHYAKSRLNRSYNMCHILYNYNNSSQPRYLYKNI

SEQ ID NO: 7147 - protein, 365 aa, Acinetobacter baumannii
MKSYYLDSFYQINVYNDIISIDLDWNFMSDWPPKPQNEPITPKQNGPEWQILEKAVLASVEEQRRSRRWGIFFKTLTFIYLLFIIVLMGKGCSTTKDGSTASSSSAHLAVVDIIGTIDASSNQAVNSEDTNKALKRAFEASNSKAIALNINSPGGSPVQSDEIWQEIRYLKKEHPDKKVYAVIGDMGASGAYYIASAADEIIVNPSSLVGSIGVIMPNYGITGLAQKLGIEDRTLTAGTNKDILSMTKPINPVQRQHIQSVLDNVHTHFINAVKEGRGKRLKTNDPAIFSGLFWTGEQAIQLGVADRSGNITSLMRELKLDNKVDYTIERNPLQSILGRMGSEMGKGLSESVAERLQTSQDAKLQ

SEQ ID NO: 7148 - protein, 78 aa, Acinetobacter baumannii
PTIQPLPKKHHAKNMNGFISQYLPKGIDLNQADQHYLNQVAMSLITRPRKALDWLTPLEKFAQLVDYHMAYETVAPHV

SEQ ID NO: 7149 - protein, 406 aa, Acinetobacter baumannii
RLNQKRLDFMQDRILRRIFLLAGIVLLVWVLYLLKPVVIPFIGAFFLAYLFSPLVEVLVKIKIPRWLAISIVFIGIGVTLTVALWYLVPLIWKQLVYARDSIPAGIHWINAELLPWISSTFHVQQMEIDTDQMSKAVMDYVQTNYSADSIQAVLLKLAQSGLNFIQIGGTVVLIPIIAFYFLLDWDRMLQNLRRLIPRPYEATTLQIVRECHSVLGAFVKGQFLVMLLLGVVYAVGLQLIGLEVGLIIGMVAGLASIIPYLGFAVGIIAAVIASLFQFGMDWTHLLLVGVVFMIGQAVEGYILQPFLLGDKIGLSPVAVVFAVLAGAQLAGFLGMLIALPVAAVIVVLLKHLRENYERSSFYAPSSTLLIQEGNIEQLHVETENTKLDLEVKKQQDTDTPNLSDQK

SEQ ID NO: 7150 - protein, 284 aa, Acinetobacter baumannii
PKCQTHCKIGYLKNFNRRVNILFSTFTFARTAEDYMKALVAVKRVVDANVKVRVKPDNSGVDLTNVKMSINPFCEIAVEEAVRLKEKGTVSEIVVVSIGPKEAQEQIRSAMALGADRGILVETTDEIGALEVAKILKGVVDAEKPELILLGKQAIDDDSNQVGQMLGALLGAGQGTFASEVKVDGGKVQVTREIDGGLQTVELALPAIITTDLRLNEPRYAALPNIMKARKKPLDTKSPADYGVTAGTKLKTIKVEAPAERKAGVQVKSVDELVEKLKNEAKVI

SEQ ID NO: 7151 - protein, 338 aa, Acinetobacter baumannii
ILLQINFKQEFPMEVHQRGLITGILMAALAISPLAEAKRAGGGKSHGMARSTTSSQSYQQPRQVTPVQQPATTAPQRSGPGVGSMVAAGVAGAAVGAVAANALADDKSTSAEHQVTQPGNEQAVQAQEEKKGGIPGWLWVLLAAAVAFFVFRKLGSKKKLAANNPYAPNNGGQNPFGRSAAPTNTGDNTNIFGQSVGGGAATQAPFGSATTNSGNQLPDGSEPASFLRVARQRFNHIQSINSASNIEKIRRYLTPELYNSMYNDIMENQDQDVAEFSNLNAMVVYSATENGQYIVSVRFTGTVSEDLNSLPQPFTEIWHFVKPVGSQQDWVVAGIQQA

SEQ ID NO: 7152 - protein, 60 aa, Acinetobacter baumannii
SLMHEQAQHADAHHLKVHLVYGPYDEIAQLDLANIQPVPLPTYIDCLLEALKASLHFQEQ

SEQ ID NO: 7153 - protein, 250 aa, Acinetobacter baumannii
VSWQLFIRHFVQPKFNLPRHCVMSKVVLEAKDIYKHFDDGKSKVEVIKGLSLQVEAGQFVSIVGASGSGKSTLLHVLGGLDQPTKGQVFLNGQRFDNLGEAERGFQRNQYLGFVYQFHHLLPEFTALENVAMPLMLRADSQYKSVKAQAEYLLDRVGLSHRMDHKPGELSGGERQRVALARALVTKPAVVLADEPTGNLDRKTAVGIFELLTDLKKELNMAMLIVTHDEQLAQAADSILHMEDGLWVNGS

SEQ ID NO: 7154 - protein, 377 aa, Acinetobacter baumannii
WGHNMNQDSAHSEQNSPVADTAETNQNQQNTQTDNAQEVETSKSDSQPPKNTKIKLIIAVVVIALLGLIIFGLWKSYQPKPIELQGRVEAETVHVSTKVPSRIEEIYVQEGQKISKGQPLVRLVSPEIEAKKQQALATLQSALAFQSTVDRGSQQENIDTLYANWQSMKAQANLAKTTYQRGENLYRQGVISRQRRDEMLAAQTSAQELSEAAYQQYARAKRGSTSQQKSTADAQVEIAKAAVSEAQALEAETRLLAPISGTVSKTYGKPSELVAMGVPVVSILEDDDLWVSLNVGENQYASVYKNKTLEGFIPALNQSVMFKVKNIDAEGEFATIKTTRQTGGYDIRSFKLHLVPERPVKDLKVGMSVLFKIKEEK

SEQ ID NO: 7155 - protein, 505 aa, Acinetobacter baumannii
KVVKKYTFKRYLQMVRYRLFDLILANGLKKLLECIHKMSNQNLSDPHEQGELHRSLSNRHLQLIAIGGAIGTGLFMGSGKTISLAGPSILFIYMIIGLMVFFVMRALGELLLSNLTYKSFIDFSTDLIGPWAGYFVGWTYWLCWITIGIADLSAIIYYLQFFNNGLPFSPVEGAMISVAAIVFIMGLNLLTVRLFGELEFWFALIKILAIIILIAVGLWMIFTGFTSTTGEVASFTHLWANGGFFPTGVHGFLAGFQIAIFAFVGVELVGTTAAETKDPERNLPKAINSIPIRIIIFYVLALLIVMSVTPWNRIDPAISPFVNLFSQAGVAAAAILMNLVVLSSVMSSMNSGVFSTSRMLFGLSREDQGPKAFGKLNRRAVPANALYFSAACLLLGAALQYFVPNTVEAFTLATTLSTILFICVWLLIIWSYIRYYTTRPELHAKSTFKLPGGLFTCWITIIFFIGMIYVLSLEPDTFKALKVSPIWFVILIIGYFFFYKPRHKK

SEQ ID NO: 7156 - protein, 365 aa, Acinetobacter baumannii
SAANAETSFMSNSTSTPNTGLSYKDAGVDIEAGDALVDRIKSVAKRTTRPEVMGGLGGFGALCKIPKGYEEPVLVSGTDGVGTKLRLALNLNRHDTIGQDLVAMCVNDLLVCGAEPLFFLDYYATGHLNVDVAANVVTGIGKGCELAGCALVGGETAEMPGMYEGEDYDLAGFAVGVVEQSKIIDGSKVKSGDVLIGVASSGAHSNGYSLLRKILDVKNVDLTQVIDGRPLADVAMEPTRIYVKPVLELCKQVDVHAMAHITGGGLPGNLPRVLPNGAQAVINEASWEWPELFKLLQREGNVERFEMYRTFNCGVGMVIAVDANDAEKAIEVLNAQGEKAWKIGHIQENAESVEGADEKIRVIFE

SEQ ID NO: 7157 - protein, 66 aa, Acinetobacter baumannii
WMCKANSFLLGVLPDIYRIMVAERERVSRLVLSQTSTPEGVPLPSYRYGKGTSSSPHKTVPQKEKL

SEQ ID NO: 7158 - protein, 308 aa, Acinetobacter baumannii
MESNLDFALQLLSMWLKERKIQNQSEHTITAYERDVRSFLEFCELKKVDLRNVEASDLREYLAQRVEQDQLSSSSMQRHLTSIRQFMKWAEQGKYLEINPTDDFKLKRQPRPLPGMIDIETVNQILDQPMPEKPIDQQLWLRDKAMLELLYSSGLRLAELQGLTIKDIDFNRQLVRITGKGNKTRIVPFGKKAKESLLNWLKIYNIWKGHFDQNASVFISQRGGALTPRQIEKRVKLQAQRAGVNVDLHPHLLRHCFASHMLSSSGDLRSVQEMLGHSNLSTTQIYTHIDFDHLAQVYDQAHPRATKH

SEQ ID NO: 7159 - protein, 241 aa, Acinetobacter baumannii
VYQKLFNQENLISHSIMNPTYILHFIPSIRWTYTMTAILIPYLIAITLLTLTPGLDTTLIIRTATLEGKSKAFQAALGISLGCIAWGIVVACGLGALLMASDLAFNILKWMGAAYLAWLGLNMILKPRSQLADIQDNHSNRSTSENWFIKGFFGNLLNPKVGIFYISFLPQFIPAQASAVTWVMGLVMIHVVIGVLWSSLLILAMQPLSRYLKQPKFVKYMDRITGSIFVLFALKLAFSKR

SEQ ID NO: 7160 - protein, 806 aa, Acinetobacter baumannii
EDEKVDNSEEQKHIQENNGFARIEPYTHPAGGWGALLSVARNLKRQDILGKGSITLLNINQPTGFDCPGCAWPEKKDAHAFNFCENGAKAVAFEATSKTVTPEYFAGHTVSWLSEQSDFFLEDLGRLTDPVRYDAATDKYVPISWDDAFKLIAQHLHALDNPDQAAFYTSGRASNEAAFLYQLFVRSFGTNNFPDCSNMCHETTSVGLLDSIGLGKGTVTLEDFDLADAIFSFGHNPGTNHPRMLGTLREVSKRGGNIIAINPIKERGLERFQDPQAPLEMMTNGSTPISRYYFQPKIGGDYALMLGILKHLHEWDKKALASGKPSVFDRNFIAVNTVGFDEMIAEVERTEWADLYKHSGLSPEHLEKLAKLFLESERSIFCWGMGITQHRHGTANVHMLANLLLARGQIGRPGAGLCPVRGHSNVQGDRTMGINELPSPKLLDNIDRVFGIKSPRKNGYGVVETIKAMAEGDIKVFIGLGGNFAVATPDTAYTQEALRKCNLTVHVATKLNRSHLVCGKDALILPCLGRTEIDEQLHGPQAITVEDSMSNVHLSAGRNTPISKNILSEPDIVARMAEAVLPESQIKWKWYIESYDRIRDSIADVFDEFHDFNLRVYKPGGFHLEHPANQHIWNTKSGKAQFLITPLEEVYVDKENQYAAAYTESKVYTLMTTRSHDQYNTTLYGLDDRYRGVFGQRRVLFMNQADIDEAGFEANQWVDIESVFSDGVKRIVHSFRIVPYNIPRGSLAAYYPETNPLVALSSHDKYAKIPASKSVPVILHPGNAPEHFNLATAVDPEDANKKVSSL

SEQ ID NO: 7161 - protein, 380 aa, Acinetobacter baumannii
FNTLNIVLCHNSKDNNVFISYGLQTMKIVADENLAFTDYFFSEFGDIQHKAGRTLTHTDVQDAEALLVRSVTAVNESLIQNTALKYVGSATIGTDHLDIQALEKQGITWANAAGCNAQAVAEYVITALLHLDASLLEQQEKFTLGIVGLGNVGKRLAYMAQLLGWKVIGFDPFVQLDSIENVSFQTLLQQANAVSIHVPLTKKGEHATYHLFDEKAFAALQPNTILINSARGPVVKEAALIEDIQRTQRKVVLDVFEHEPVISEELLNMLALATPHIAGYSLEGKARGTQMIYEAFCQKFGYDINKRFETQLPACEDYFSGHDLKAVLKQKLSQIYDIAQDDANIRAYIKDGKVEQKAFDLLRKNYPLRREWAAHGGPQA

SEQ ID NO: 7162 - protein, 452 aa, Acinetobacter baumannii
SRMKTMKNYKKALLALSILATMPLFADSTNKRIEVTTFADEDGENPNACSLREAIKVAATRKSDYGCTIFSLDDNQAIQLKAGTYTLNKELVPNANISIYGYGERGEDKNWAEKNPLTNDYPALPELKTRINAAGKSRIFNTAENKKALTLQNIILENGIASTQGGAIYAGGNVTLLDSQILNSQAPKGGAIFLGGSGVNLSISHSLLQGNQAVTGSVLAMSCKEEPAYAKRDITIMSSSIFKNGSLNSKSTFEFCGEPNAILTINTIAKNIADKINGSILKFTGDAVPGSTTNPSTILSGSSSLNLQNNTIVENTAHTTFLYDSLGIKELRFNLIGYNLGSYACRYLVGPAADLKNSGFTLSFNALNLTNNVEKCDLPTEALTSSNKTIDIANIPFSSLLEPQSSASPETGFLPVYYPLNNTSSPQNDLIDVDPDGKDGRVKLEVRHKPPN

SEQ ID NO: 7163 - protein, 285 aa, Acinetobacter baumannii
GVNEMLLEFTKMHGLGNDFMVVDLISQRAYLDTATIQRLADRHFGVGFDQLLIVEPPDVPEADFKYRIFNADGSEVEQCGNGVRCFARFVHERHLTNKTNITVQTKAGIVKPELGQNGWVRVNMGYPKFLPNEIPFVADEPEALYTLELANDQNISIDVVNMGNPHAVTIVPDVLTADVAGIGPQVESHKRFPERVNAGFMQVIDDKHVRLRVFERGVGETLACGTGACAAAVSGMRRGLLANSVEVELAGGKLQIEWQEGDVVWMTGPTTHVYDGRLDLRYFQG

SEQ ID NO: 7164 - protein, 321 aa, Acinetobacter baumannii
SESDLIRKDKIMSILVIADHNNQTLNGATLNVVAAAQKIGGDITVLVAGSGAQAVADAAAKVAGVSKVLLADNAAYANQLAENVAGLVADLAKGYKYVLAASTTTGKNILPRVAALLDVSMITDIISVESANTFKRPIYAGNAIATVQSDEAIIVGTVRGTAFDPVAAEGGSAAVETVGEVKDAGVSKFVSEEIVKLDRPELTAARIVVSGGRGVGSGENYHKVLDPLADKLGAAQGASRAAVDAGFVPNDFQVGQTGKIVAPELYIAVGISGAIQHLAGMKDSKVIVAINKDEEAPINSVADYWLVGDLNAVVPELVSKL

SEQ ID NO: 7165 - protein, 275 aa, Acinetobacter baumannii
FKQDNGMSVKPVIHFAHANGVPSMVYQKLFDQLKDEYDVIYVPLIGPDKRYPITNHWPFLVDQVIDSIVRQAKGRKVIGLGHSLGSVLTLMASFRRPELFSQVIMLDPPLILGRYSFAFHMAKLFKPKIVDDMTPAGLSARRREHWESREQAAALLRLKGFYKDFDEDCFQAYIDYALKEDSVRGGVTLTISREDEVAIFRKNPSWWWLPMPKPKMPVHLVVGKESAFLKRGFPQMAKRKMGIPFSVVEGGHMFPLEHPIDTVNYIKELIHRNSR

SEQ ID NO: 7166 - protein, 506 aa, Acinetobacter baumannii
TIRDDQKLLYKMPTHQYRQSKRPFLFKPNYLALVLGVLIATPIYAQSLSYAEAEQQALKSSYSTQANQALQQASQLEAEAVKGLGLPRVDLNVRAYAFHSETDVPLGSFKQKLENDLSQGLNDKLSQWNNVIPSDVLGQVQEGSNQIIHDGINRFPDYANLTVEDQVVRPSISVVMPLYTGGLTTSAKKIANIQAQRSKLSSQQQQDIQRFEVVQSYFNVQLQQQLVASSLFNFNAMQKHYSNALKLEQQGFISKGQRMQFEVARNNAERTLQNAQANLNASQFNLNNLLHQQNNADLSTPLFVNTVRSQSLESLLSSYSQKSSLVQKMQLDTQLANANIQAQQAAKKPSLFAFGEYSLDENENWIVGVMAKYNLFSGVDKNKNIHAAELKRYASELMTERTKQEIEALLNKSYNELNSAQQSHTLLQRNISAAQENLRIQELSFREGMGTATQVIDAQNALSALKTEMALNAYKYVMSLATLLQSHGSMDQFKAYVTQPHTDYIR

SEQ ID NO: 7167 - protein, 393 aa, Acinetobacter baumannii
KFICIRAFMKVVIAPDSFKDSLSALKVAQAIAQGWQAVFPHAETILCPMADGGEGTIEAVLEVCDGQWREKTVVGPLGQPVQAKWGWLEKQKIAMIEMAQASGIQLVPPSERDACHSTTFGTGQLILDALDAGAKDIILTVGGSATNDGGTGLLSALGAVLLDANQKVLPAGGLALSHLSKIDLTHFDSRIQHTRFLLAADVTNPLCGPNGASHIFGPQKGASAAQVHLLDAALAHFADVTAQLLGFDKRNEAGSGAAGGLGFAAKSYLNAEFKAGVKVVAELNQLEHKISNADWVITGEGKFDQQTLSGKTVFGVSQIAKAHNVPVIVIAGTLGEGYQALYEHGVSAAFSLANGPITLEHACEHAAELIYERTVDIARLIQFSQTSLKDKKT

SEQ ID NO: 7168 - protein, 908 aa, Acinetobacter baumannii
EGVCMSVSEIRPIAIEDELKHSYLDYAMSVIVSRALPDVRDGLKPVHRRVLYAMHELGNDYNKAYKKSARVVGDVIGKYHPHGDLAVYETIVRMAQDFSLRYLLVDGQGNFGSIDGDSAAAMRYTEVRMTKLAHELLADLEKDTVDWEDNYDGSERIPEVLPTRVPNLLINGAAGIAVGMATNMAPHNMTEVVNACLAYADNPNISIEGLMEYITGPDFPTGGIIYGKSGIVDAYRTGKGRLHIRGKYHFEEDEKTGRTTIVFTEIPYQVNKARVIERIAELVKEKKLEGISELRDESDKEGMRIAIDLKRGENAEVVVNNLFLNTQLENSFSINMVCLDNGQPKLMNLKDIIAAFIRHRQEVVTRRTMFELRKARERGHILEGLTVALANIDEIIETIKTSANPAEARERLLAGEWAGGGVVALLEKAGAISVRPDEIEGEDPNRPFGLSDSIYRLSPTQVGAILELRLHRLTGLEQDKLHAEYTEILGQIAELTAILNDFNLLMGVIREELAQVLQQYGDARRTEIVESRVDFCREDLIPEEQVVLTVSQTGYAKTQPLSDYQAQRRGGRGKSATSMKDDDFIQHLIVASNHATVLCFTNVGKVYRLKVFEVPQASRGAKGRPIVNLLPLDATETVTAILPLTEFPENHYVFMATASGTVKRVELEQFANIRSNGLRAIELNEEDTLIGVAITDGNQQIMLFSNEGKAIRFAETDVRAMGRTAKGVRGMRVSFASSTLSEEDADVENDDSDDNDDSADSSLVSRIVSLVVVPETGEVLCASANGYGKRTPVNDFPTKKRGGKGVIAIKTSERNGELVGAVSIDETKELLLISDGGTLVRTRAAEVAMTGRNAQGVRLIRLSEEETLVGVVSIEAVEDEEELLEGEVDTTETDSEEAVSNNEDTSEE

SEQ ID NO: 7169 - protein, 226 aa, Acinetobacter baumannii
NLRCAKHSLYRLCCAFFSPKKVSHLQTTRIYNGKTMPNLVLPTRALYVVNKAIDLFHHRGFHLIGVDRIVRESEITKATFYNYFHSKERLIEICLMVQKEKLQEQVVAMVEYDLSTSAIDKLKKLYYLHTDVEGPYYLLFKAVFEIKNSYPNAYQTVVRYRTWLKNEIYSQLRLLKPDVSFTDAKLFLYIVEGTIIQLLSSGGVDERERLLNCFLGQFITESKSIL

SEQ ID NO: 7170 - protein, 61 aa, Acinetobacter baumannii
ALSRFNWNKKQNVEIICIFLQICLKEIDEITQLTILFFAHFVGIYSLKTINFDSFLRVLSF

SEQ ID NO: 7171 - protein, 346 aa, Acinetobacter baumannii
AIVRSFIIKVVLLRLFEMGMFVNNITMNLKMNKDYSLEAPQGNASISNSILVGNTINCQANSTDKAIIQSNLVTTECNRNASVKVPNILYPANQKLIVGSTDEGVCDVASKDGLLCPFNTPKDSFLGFFKPRLLESYNTLADSLIINKGRLYSDGTSVGLASCETLDQRGKRRTGYDELCDLGAIEYILNSDISSVGQDIRYGQVAKFSILGSLSEADLVTPATCKRLFGERPDGKEWQPGCLKIKQSTDTPVSKGTVTIDQNGNVIYTPNGNWHGADIFSIQVVTSISRFNEGVEFQYITIPTRIVQEPLSGIEDKSVSSGGGGSIGAGFILSLLGLVALRRFKS

SEQ ID NO: 7172 - protein, 65 aa, Acinetobacter baumannii
IRPSIEIFTREAAATLSNLWLNAFFYCVSLLQGKNHARVQFLCWSCCITYCRFRKSSTRIVGLAR

SEQ ID NO: 7173 - protein, 254 aa, Acinetobacter baumannii
KTARYRYPESFRSEIISRPIHYMRQLQLDIEPQLDARISDFSGPGWGHVVDAVRQLHAGLVNRFYIYGGAGTGKSHLLSAICDSYLEVGKSAIKVSLLELLDAPIEAITCLEHYDLVALDDIESISGVPHWQKAVFHLMNNHEGQLVFSSRVAPIELKLELPDLQSRLTQAVSVKVPSGSLYADRYALVTSVMARRGIHFDQQIVDYLLLHGPHQASVLLQTVAQLEKLLKGEKTKLSNATLRQIYALIDEYQQ

SEQ ID NO: 7174 - protein, 139 aa, Acinetobacter baumannii
NSKGSESVQMSWVQSIKEWAKRLKKQIIMLWFASRHPQMPWLPKIIAVVAVAYAFSPIDLIPDFIPILGFIDDAVILPILIWLAVRFTPQQVIFDAEQQAKEWLDEHEKRPKNYLVAVLIILIWLTLAVMAYFYFGGGL

SEQ ID NO: 7175 - protein, 204 aa, Acinetobacter baumannii
ENLMNVIDALRKRRAVKRFDPAFQLSEDDKKQLLQEVLANAPSAFNLQHWRPVIVEDAELRQKIRAIAWDQPQVTESSLLIVLCAKVNTWEVDAKRVWDGASPEVQDIMVGAIDQYYRDRPQTQRDEVMRSAGIFAQTLMLLAQEHGLDSCPMDGFDFDAMAKLINLPEDHVVCLMIAVGKAASEPYPRVGKLPYDDVIIQNTF

SEQ ID NO: 7176 - protein, 551 aa, Acinetobacter baumannii
GLCMQQWLRSSKFLLIFLPIWLFVLSWIRPLSVPDEGRYGDISRTMFESGDWLTPRIDGLPFMHKPPLLHWLSSMFMELFGVHVWVLRLVPVLAGTLMLVGLFLFVKKHISENVAQLTVIILATNLLFFGSSQYINHDLLLTSWITISVLCFVDFTISARKSILFLGYIAGAAAFLSKGLIGILIPGMILLPWLIYTKQWKKIPSLLNPLAILLFLLIVSPWLYLVQSKYPQFLHYFFIDQQFNRFSSKEFNNKQPWCFYLMILFVSFLPWLFASRFTSIKTIFKDYKSCSLLALFVWWFVSVTVFFSIPPSKLAGYILPAVPPLAIFFSLVMNKVLESSNKTRLQTWGIPVFTVLVGIGVSATPHFIRAHQPFFQNQAIFIYLIGALLIVLPLVLVGLYKKQKLNYLTYIFISLIVLCSAVPFAVRILDTKNNVGQTDFAEYIAPSTKIVFYDYYFYDVPFLLQLKHPVYIVNQWDTVHSDSASLEIKDGLLFEPQLKKYLWSEQQLQDALMQKQDLIVVSQPHNFATKDPSVKTLHYRNYDVFIFHPSK

SEQ ID NO: 7177 - protein, 493 aa, Acinetobacter baumannii
AKCIPYRLSSLLGFLLYSAFNDYEVISLKSNMSKVKTVYRCEQCGADHLKWAGQCSECGEWNCLNEVKLEPTTAHRARPKVGGYAGQVANITTLNKVSVSHETRLPTGISEFDRVLGGGLVTGSVVLIGGDPGIGKSTILLQTATHMASAKSSALYITGEESLSQVALRAQRLDLPTDQLKVMAETCVERICEVLEQEKPVVAILDSIQTLYTETLQSAPGGVSQIRESAALLTRYAKNSGTALFIVGHVTKEGALAGPRVLEHMVDCVLYFEGQSDSRYRMIRAVKNRFGAVNELGVFGMTDKGLREVANPSAIFLSRYDEAIPGSIVMISREGTRPLLVEVQALVDDAQGQPRRVALGLEQNRLNMLLAVMHRHGGVQTTGQDVYVNIVGGLKITETGSDLAVLLACASSLRTKALPQQLAVFGEVGLSGEIRPVPNGQERLKEAAKHGFKYVILPRGNAPQKAIPGVQVIAVARLHEALTEAMQLSDELT

SEQ ID NO: 7178 - protein, 341 aa, Acinetobacter baumannii
LSTIRYPAHQTRGNAMNIKPFLSCVVPAYNEAENLKTFIPALANSLKQQNLSYEIIVVDDGSKDDTIPILQTMIEDYPLVVLELSRNFGKEAALSAGLDHVTGEVALLIDADFQHPFEAIPTMINLWKNGYDMVYGIRNRTTESWLKRVLTQAYYRILNLSSPIDIPESAGDFRLLDAKVVEAIKQLPEKNRYMKGLYAWVGFKSIGINFSEQERQHGRSSFNLKSLFNLAMSGLTGFSDLPLRVCIYLGAILALGAMSYGVWIIIKTLIEGISIPGWATLAAGMTLLGGIQLLFIGILGEYIGRIYAEVKNRPKYIISTEHSRTKQEHSIAHQENTFSSF

SEQ ID NO: 7179 - protein, 306 aa, Acinetobacter baumannii
QRKMKKIGKEKGMLKRSIAFALLAAAGHAYSADIEVTTTIDEDVDNTVCSLREAVELINKRNSSDSTVVASVKDGYHGCGNKDSSSNIILQRDKEYTLNSRITITAPLTISTAKNDSTLVDTDQPGSHNATIKMAGTDQLFKIDDESVEKASFSVLLSDLNLQGAGANSKVLTGGLILNHEKLTIQNSRLTGGYANQGGVIYNQGFASKSDRTFGFVYIVNSLIQNNKAAQGGVIYSEQPLFLITQSVIRDNEVSNISGSLFFSQDSFDDESTGEYVVQRAIGLSNSTVFHNKGGFITTVRDGDVC

SEQ ID NO: 7180 - protein, 209 aa, Acinetobacter baumannii
MMKIAVLVSGNGSNLQALIDANLSGQIVGVLSNKADAYALERAQNANIATAVISHKDFPSREDFDEAMHQQLIAWQADVVILAGFMRILTADFVNKWQGKMLNIHPSLLPAYKGINTHQRVLNTGDRLHGCTVHFVTSELDAGQAIAQSAIEVKEHDNVASLAERVHKLEHFIYPQVAEWLCNGQLTWKNGQAYFRNQILEHPIRFASW

SEQ ID NO: 7181 - protein, 810 aa, Acinetobacter baumannii
MFKIILLGWIGGIALMGIDFPLIMQYEKVGEALLLLAFIFYLYKRPMFVDRPFLKAVFCLLCTTSLFMVGYHYAEKALIERLEQRETDTRNFDIIVYINRLSEEKDNKVQQTAQVLNLSKEPVNWLLYLKSNNQNLLKNNQNLELGHYYRISGKTRPAHSYATPGAFDQEKWFIQRNIMAGFNVRYIEPLSLDEIYRLGYQQHLKEQQSFSNSFRLNIEKLRLTSRQILNSSSLQQKGLILALLTGDESLLSDETQLQFKQLGISHLLAISGPHVLIFAIMLSWACHQFISRYYPQIYLWKPKQVLMAVPCCLGVLIYTAFVGFEIPALRTLLSAFIFIGFLLLKQPIKPFTLLVYSASLLLLIDPFSVLSAGFWLSYGACFILLRIYQTIAQLPEQHFLSLSSKMIFMGKVLIESQGKIFIALSPLTLLFFQQISWVAPLTNIIAVPIVGGVIVPLNIMAACAWFIVKPFGNMLFHFNDMLLSILLSCLGLLEKLSLPLQGISLTPLSLLAISCAIIILFLPKGILPKTWGILCCLPLVIMNKTSQQIQLNILDVGQGQAIFLQHSEQNWLIDTGGSYDEKIFSIGQNVVVPFLRQQGVRQLDHVVLSHLDQDHSGAFPLIQQEIPVKQLISNEQLPNDLKQPFQYCHQGQQWHYPELDIQILWPKEKDLAFVTSNQNQYSCVVYLQFKKVGGYQNFLIMGDAGWEAEYELLKDYPNLKIDVLVLGHHGSKHSSAYDFLATLKPKLAIASAGFDNRYGHPSQEVIARLKALHIPLKSTVEQGTLSFVLENHKIVLHDRRLDRLWLSRGF

SEQ ID NO: 7182 - protein, 170 aa, Acinetobacter baumannii
NASVRLIFLVEIENNVLPFKLWVDADALPKILREVILRASDRYQLEVIFVANQNVGITPSVRIKSLQVLSGADQADQEIVNRMSENDIVITQDIPLAAQVIEKGGIAIHPRGEVYTTANVKARLHLRDFMDTLRGAGVQTGGPPPISERDKREFSSALDQTILKQKRKTA

SEQ ID NO: 7183 - protein, 269 aa, Acinetobacter baumannii
IRPVEKTIKAIKNKERVLFDSEWKDSLDIQIKRALKSNEMKAYGRTEPGLLFRMQTVGRMTVTNELLLKARQLSGTPIIEAATSWQFFNWKLEYDAEQAQKYYGSENLHITKGLTDLSKTDLPWLGNIPPESLLELRKQGALEEIRNILGHEIKELIKTNPTNCSRTRDQILQNIEQSFDRHRKKLDELKAKNWKFAGKDIGSWVVTGTLGIGAALTGEATWGLRAWIANEVMDAPKLREIPQRFRDLVDQNKQVKQSPVGMLFKASKS

SEQ ID NO: 7184 - protein, 313 aa, Acinetobacter baumannii
SKNVKLLSESLMPSQTNLASTYVLLVFIWATTPLAIVWSVSDLHVMWALLLRFYIALPLSVIVLLVLKTSFPTHKQALHSYFAGSFSLIGSQIFTYAATQYLSSGMIALMFGLAPIMAGLIGRFAFGQHLFKLQWLGMAVAVCGLAIICLNGSNQHVHPFGIVLMLVSVFVYSFSIFWVKKVNAKIQPMAQATGSILVSSILASCLIPFIWQYAPTHLPQAKSLFALIYTVLMALLVAMFCYFKLVQNIKPTTLSLTTVITPMLAMIIGAVLNHEQLSIMVFVGAFIILFGLFLYFYKDIQANRNFAHHIKSK

SEQ ID NO: 7185 - protein, 109 aa, Acinetobacter baumannii
KAGVFYAYCFSIQVYSLAACLITVYCIELFKSGAQMRRVICLISLLSSSILLSACGQSGALQLPSDPNYDKRAKYLLYRNKEQKQVVQQDEQAEQSVESSAAQPQTTSP

SEQ ID NO: 7186 - protein, 373 aa, Acinetobacter baumannii
MPFFIVFHFYKGKIMRAYNFCAGPAALPTAVLEKAQQELLDWQGKGLSIMEMSHRSADYVAVAEKAEADLRKLMNIPENYKVLFLQGGASLQFSAIPLNLLGKNNKADYIHTGIWSEKALKEAKRYGDINVVEAGIKVDGKFAISEQSEWNLSDDAAYVHYADNETIGGLQFAGVPDVKAPLVCDFSSSILSAPLDVSKFGLIYAGAQKNIGPAGLTIVIIRDDLLDQAKAEIPSILKYADQAKNGSMVNTPSTYAWYLSGLVFEWLLEQGGVDAIHKVNLEKAQLLYGYIDSSDFYNNPIAIPNRSIMNVPFTLADEALEKQFLKEAEANHLLNLAGHRSVGGMRASIYNAVPLEGVQALIRFMDDFAKRNG

SEQ ID NO: 7187 - protein, 219 aa, Acinetobacter baumannii
KRLSFICTIFLILLPYKNMNNLIFLPGASGSISFWYPLIEKLPQHYRTKIIGYPGFGDTSESLDVKSFKDLTNYVLNQINEESIIVAQSMGGIFAVAAALHKPQLVKGLVLIATSGGINLEPFNVQDWREAYRQAFLKYPDWFVTTNANYEEFLSDINIKTLLIWGDNDPVSPVQVGQYLNQKFENSTLYVVKGGDHQLAEKYADDVAVQIKNYLKGLM

SEQ ID NO: 7188 - protein, 82 aa, Acinetobacter baumannii
AYPSPYLFFSFFFVNIAKFPLLQMHPLCVLCHRNQNFSRCFDRSIASFSIGNFLNICTIKDLLIYENFTYKKFKSIFPRLKE

SEQ ID NO: 7189 - protein, 426 aa, Acinetobacter baumannii
MNTSLFPSMTLDLEGMFKPISLYIGLRYTRARRSNHFISFIALVSMVGLTLGVAVLITVLSVMNGFDRELKNRVLGMVPQATVSSTQILTDWPELVKRVENHPHVTGVAPFTQLQGMLTAQGQVAGIMVTGIDPKYEKNVSIIQNHIVAGSLDSLKKGEFGIVLGKDMADSLGLRLNDSVTLVLPEATPSPAGVVPRFKRFKVVGIFSVGAEVDSMVGYIALYDASTLLRLPDGAQGVRLKLDDIFAAPQVADDLVKNLPSNFYATNWTYTHGNLFNAIQMEKTLVGLLLVLIIVVAAFNIVSSLVMVVTDKKSDIAILRTLGASPSMITKIFMVQGTVIGVIGTVAGTVLGVILALTISDIISWFNNVLGLNLFDAYFVHYLPSYLRWQDVTIIVIVSLLLSFLATIYPALRAAKVQPAEALRYE

SEQ ID NO: 7190 - protein, 783 aa, Acinetobacter baumannii
NLSSILELVIFILARCIKINGARKMMDAAAAQQSKTDVTACILCSRNCGLSVEIKDNQFVKIKGNPEHPFSQGYICQKAARLQHYQKHADRLTAPLKRQPDGSFQEISWDVAIQEIANQLVQIRDKFGGTAFALVGGGGQGNHLGAAYGRQLLLAMKSYYAYNSLAQEKTGDFWLNGRLFGSQACHTTEDVEHADYVLFIGTNPFQAHGIPNARDTLKHIKKDPNRTMVVFDPRVTETAKQADIHVQLKPGTDAFLMSAMIAIIIKEKLYDAAFIEQHTHGFEEVKAAFNHVPIEDYIAKADVPVDLIYQVVRDFSKAKRGCVRIDLGIQHTLNTTLNGYLEKLLYLLTGNFGKQGTNNLHTMFIPILTDTDERKPKYRRSVYHKMFPISGFFPPNILPDEILKAGEKRIRAVFVDSCNPLLTYPDTPAFEEAFKALDLLVVVDVAMTETARLADYILPAHTQFEKWEFTGFNLEFPKNGFHLRHPVLAAQANTLPEAEIYTRLLEAMNAIPKSFPVLEKIAAVDSKKTAYLPYLSALGITLARHKKYIPFAASIIYRTLGKRLGNSADSVAFLLPLSIQYAVLHTKAVRRAGYKGNPLTQGVKLFEQILKQRSGMVLSQHEYDEVWKLVAYKDKKIRLVIPEMLSELARLKSHNVNVEEFPFILLSGERRSYNANQIYRDPAWRKVDAEGALRIHPEDARHLNVDAGGQLKCISAHGEIQVAIELDDGMRRGVVSLPHGYGMRFQNGEPIGPQLNLLISAEHCDPLSKTPYHKYVPIRLEKC

SEQ ID NO: 7191 - protein, 613 aa, Acinetobacter baumannii
YMSSEAHSISLIAPVVLLAAAVIAVPIFKRIGLGSVLGYLIAGLIIGPFGFAFFQDSTAILHIAELGIVMYLFVIGLEMQPSHLWSLRREIFGLGTLQIISCAVALTGVGLLFGFTWQVAFIGAAGFVLTSTAIVMQLLGDRGDLTQPRGQKIVAILLFEDLLIVPLLAIVAFMAPNHVVESTAVRFENIGIGLLAIAGLIAAGHWLLNPLFRILAAAKAREVMTAAALLVVLGAALLMQVSGLTMAMGAFLAGVLLSESTFRHQIEADIEPFRGILLGLFFLGVGMSLDLSVVAQNWQLIVSSVIALMFAKAIMIYMVARLTKSSHTEALDRALLMAQGGEFAFVLFSAALSAQVIDSTIKSNLTAIVVLSMVLTPIVGIIFKRFTQSKANVSLENINIAEGLTGNVLMIGFGRFGQVTSQLLLARGVDVTIIDNNTDMIRNAERFGFKIYYGDGCRLDILHASGAATAQAIVVCVDSKETTNRIVELVTHEFPLAKLLVRSYDREHSLHLVKQKVDYMIRETFESAIKFGGVILQELGVDEDEIERITEEIRDLDNERFETEIAADDVYAGAGMQYTHAHHPRPTAPLIRPKQEGRILNKDDASDNENMDG

SEQ ID NO: 7192 - protein, 88 aa, Acinetobacter baumannii
PAPFFKLTVAGVCPVWTFTPLRFLISIVADSGTLVKVSVCEEPVMMLAQPFNPIVKATIEVISNFFIINPEEFIYRYLKMHYIKINKK

SEQ ID NO: 7193 - protein, 254 aa, Acinetobacter baumannii
FRVSSLHYVLILNTNEYQHFLGEDALDSIKQYDDGHVFTAWVALIGTVMAATCLLCFLAVTGFDLHQIFKPEFALTLSAKDQALFRTSMISDCFGFYLPFLAVGVYLWRKLRPSGGLLSDIAILFLVISTMLGITGAALQASVLGPLAETYMSGNEIAKQAAGTVWATISQGSQNGLWPMEGPTIGFWAIVNGLLLRKNKSVLGFPLVLVGLGYVGFAVLLFSGFSQAALFLELFLLPVQVVWLGIFGLSLLQR

SEQ ID NO: 7194 - protein, 72 aa, Acinetobacter baumannii
RNRFSEHKDYLLTTNDQSLNIVLLTMLDSGRNFIQDDKLIKQNFLNFNSCIVIFFKLGPSILYMRFISFNFI

SEQ ID NO: 7195 - protein, 684 aa, Acinetobacter baumannii
ASRLASQGVVMSLYPHLLKPLDLGFTTLKNRVLMGSMHVGLEEAPGGYERMAAFYAERAKGDVGLIVTGGIAPNQAGLTFAHASKLDSTEEAEKHKVITEAVHAAGGKIALQILHTGRYSYQPEIVAPSAIQAPINPIKPKAMTSAEVQQTIDDFANCAKLAQYAGYDGVEIMGSEGYLINEFIAARTNHRDDEWGGSYENRIRFPVEIVKRTREIVGENFIIIYRLSMLDLVEGGSTLEEVIQLAKAIEKAGATIINTGIGWHEARIPTIATKVPRAAFTWVTEKLKGEVSVPLITSNRINTPEMAEHVLASGHADMVSMARPMLADPEFVLKASEGRSDEINTCIGCNQACLDHIFSMKIATCLVNPRACYETELIFKEAQNQKNIAVIGAGPAGLSFAVYAADRGHQVKIFEASHQIGGQFNIAKTVPGKEEFYETLRYFNRQIELRPNIELVLNHPATYEELSQSDFDEIVVATGVTPRQLQFEGINHPKVLSYLQVLKERVPVGQRVAIIGAGGIGFDTAEYLTHEGESGSLNPEKFYEEWGIDTHYEHVGGLKQPKVEASEREIYLLQRKASSVGAGLGKTTGWIHRTGLKNRNVKMLAGVQYDKVDDQGLHITVDGKPTVLEVDNVVICAGQESFTAMYDQLKADGKNVHLIGGAKEAGELDAKRAIRQGAELAAVL

SEQ ID NO: 7196 - protein, 149 aa, Acinetobacter baumannii
LFISFAMCWGNLMKNIFAFIFGGLFSLGLMISGMSNPAKVLGFLDIFGQWDISLMFVMLGAIAVAFIPFQRAIKKPKTIFNEQIQLPTNTQIDQRLIVGAFIFGIGWGIAGICPAPALTLIGLGHFEALYFIVAMLVGMFIYRILNKGN

SEQ ID NO: 7197 - protein, 300 aa, Acinetobacter baumannii
NYGFIHMQMKKHSLLFIALMSTTSLYANIPIESRGLSQNDGSASNTSSSNISVPTNLNWELMQKNQQLENDIRTLRGQLEEQANDIEQLKKDLANRYTDLDQRLELLHQKVDPDSATQDDSSNATTDNTTPASAPAPQTTESNKVAAVPATQTSEQQPSALTTTTQPAPAAAQNPSNSLELEKAAYTVALDAYKQGGAKKAIAPMQNFIKNHPNSIYTGNAYFWLAEFHLATDPVNYNEAKKNYNVVANQYPNSSKAPRALYQLYSIAKDVDKNTVSANQYKNKLLSQYPKSEEAKFFNK

SEQ ID NO: 7198 - protein, 327 aa, Acinetobacter baumannii
MTGLSPNIGPFGLYKEQTMYIHFKYPPIIAIASLSLVIASGQILAAPNGNPTLPGGTTQFFIAEFPPITGNYLQIISSYSKADQFNDQNGDKKYDQDLKVAAQTLRLTTTWDKKILGSDITISEIIGTYVDLNNQIHTPYGDVKLNDDGLADVLFEPLILQWNKGQQKQWQMVAGLGFVLPIGTYSKSHDVNVAGHYFSIAPRVALKYKFENGLEAAISPMVNFNWKNSDSNYKTGNELTIDYLLAYHSNNWRFGATGYYYTQLENDELDGQEIKDSKTKSFSIGPAIQYQFMNGKGPLVSASWIKDVESENKAEGQTFWLSAAIKF

SEQ ID NO: 7199 - protein, 398 aa, Acinetobacter baumannii
MTQSVCILGVTGSIGRSTLKILGQHPDKYSVFAVSAHSRISELVEICKQFRPKVVVVPEQKIAELKTLFAQQNISDIDVLAGQEGLVDIASHTDVDIVMAAIVGAAGLLPTLAAVKAGKRVLLANKEALVMSGEIMMQAAREHQALLLPVDSEHNAIFQSLPHNYLQADRTGQPQLGVSKILLTASGGPFLNHSLEQLTHVTPQQACKHPNWSMGQKISVDSATLMNKGLELIEACHLFSISEHFVTVVVHPQSIIHSMVQYVDGSTLAQMGNPDMCTPIAHALAWPERLQTNVPALDLFEYSQLNFQAPDTQKFPALNLARQAMRAGGLAPTILNAANEIAVEAFLMERIGFTSIPQVVEHTLEKLENAAAESIECILDKDKVARSVAQQYISSIGG

SEQ ID NO: 7200 - protein, 84 aa, Acinetobacter baumannii
MQQSIQIKVEAFGAIEKLLPENLLLVCPSHSLVKDVLDEIVLLHPESTKAMEKCACAIGDNVITRQTVLSEPCTLVLLSPVAGG

SEQ ID NO: 7201 - protein, 139 aa, Acinetobacter baumannii
SKFLIKALNAMLEVFRSTSSKLILLLVIVLVAILQYQFWLGEGGYFPHQALMQQIQQQAEVNDELKERNRILAAEVFDLKNGTEAIEEHARLDLGLVKPHETFVQMSTISTHYKPIYIDPNAKVDLETNETPPSPDIPD

SEQ ID NO: 7202 - protein, 208 aa, Acinetobacter baumannii
GRMSDCTKTNEKDQKILDAATKFFLIHGFSGTTTDMIQKEAGVSKATMYGCFKNKEAMFAAVIERQCTNMQKQIMSVETKAKNLRSALTEIGKTYLCFILSHSGLAFFRVCIAEAVRFPELSEKFFEVGPQRLANIIAGYLEKSVKQGEIELTSSSEVAANIFLSLLRSDAHLKCLTHPDYLISADEISTWVEYAVDLFLKNINYKLD

SEQ ID NO: 7203 - protein, 488 aa, Acinetobacter baumannii
VIMSNAVEKNNWIELQGLANASVDIITKLIHERKVSCEELVHHYFDSIEKQQSLNAFISTDKASAIQQAQYWDKYLLSGKPYPALMGILIAVKDNIHVAGFPNSAGTPALADFKPQSSAPIIQKLIDHGAIIVGKTNMHELAFGVTGYNTAIHIEGVVGTRNAVDPLHIAGGSSSGSASAVAAGMVPIAIGTDTGASIRLPSALNGCVGFRPTVGRYSQDSITPISHTRDTAGPIAHTVSDIILIDELITQEPKKEPLQPHQIRLGINTYFWNHLDEDVREQAHIALELLKEAGVEIINVDMPNLEQLNHAISFPVVVYEGKYDLIQYLKDHHVNLTIENVVDQISSPDVQAIFKQNILPQLIQDQTGQLVPVLPFYEKAISEARPQLLELYQNTFEAHNLHALLFPTSPIVAPLANEQVNSIENFQTLIRNTDPGSNIGLPGLSLPIGKGAKSKLPVGLEIDGLPHHDSEILAIGETLEEIFKDLNQ

SEQ ID NO: 7204 - protein, 109 aa, Acinetobacter baumannii
EITSLRQKDKEFPMLFHVRMDVHIPLDMPADKANEIKAVEKAYSQDLQRQGKWRHIWRITGQYSNISIFDVESNEELHNILQGLPLYPYMDIEVMALNRHPSSVRDDDS

SEQ ID NO: 7205 - protein, 200 aa, Acinetobacter baumannii
SNESHFTFAYKRIAMSLPHVLLTSLLERPSTGFELARRFDRSMGFFWNATHQQIYRELNNMLKKGWVSTLENEMDSGRKKTYQVEQLGRIELASWMTQQSEPAQLRDDLMVRLRAEAQLGNNQILPELLRHLGLHQEKLKLYQTIYDKDFKDSDDLNNRVLYIHKMILELGITMETEWIKWLEQVIPQLKLFAQDNVSGE

SEQ ID NO: 7206 - protein, 439 aa, Acinetobacter baumannii
EMESNMDFEKDVIRTVTFKLIPALVILYLVAYIDRAAVGFAHLHMGADVGIGDAAYGLGAGLFFIGYFLFEVPSNLLLDKFGARKWFTRILLTWGLITMAMALIQGPKSFYLLRFLLGVAEAGFFPGVLYLITQWYPVRHRGKIMGMFVLSQPIAMMIAGPLAGLLLGLDGIANLHGWQWLFVAVGLPAVLLALPTFLWLPDNIDKVKWLSIEQKQWLKNELVKDEAEYDQTRHANPLHALKDKRVLLLALYYLPVTLSIYGLNLWLPTIIKQFGGGSDIQIGFLSSIPYIFGIIGLLIIPRSTDRLNDRYGHLSFLYALGACAMFLSGWLNSPVMQLAALAVVAFCLFSSTAVFWTLPGRFLTGASAAAGIALINSVGNLGGYVGPFGIGLLKEYTGNMAAGLYFLSIVMLFGLILTYIVYAKLERQKTQTVNIQKPL

SEQ ID NO: 7207 - protein, 443 aa, Acinetobacter baumannii
TFVPGNFGTMEINKNRNRHGLPILRRIYMSRRIIFIGAAGEMCRLAIERFAKAKGDWELVLCDIRPELLSNLVEKLPQGLATTQHLDLYDKQKLQAVVNGADLVVLGAGPYIRTSAPVIEACLEAKVPYLDFDDDVESTEHALSLHEKAKEAGIPIYVGCGASPGMANVLVVDAANELDTVENIDCCWMVGDERPGIGRAVLEHFLHITAGDCLTWENGERVNHETFVETGTAPIGGGLGEILMYETAHPEPVTLPRKYPTAQRIRCLGGLHPAPFNGLGRGVGLAVHHGEMTVKEGVDFLEDLLNNKLGSAKGWKAAISGMIGQVKRKESSFSAMVEFLTKSAIGQTYTYKGGLLARVYGTKNGRPAVAIRRTVKSGEDSYLMRDMAAITGTACAAFMVLALDETGKRSGSFAPEDWAEPEAFYTALERVGTPRAEIVECVL

SEQ ID NO: 7208 - protein, 532 aa, Acinetobacter baumannii
RGYPMKFNQWLTLGSHLILKKWCDASDRNFQKQFNALETTQRQILHSILQTSTFAKDKKVQNYEQFVKAFPATRYSAWREDIQRYREQKLSLSSSKLVRFQPTSGSSEQIKFIPYTKLFLDELDHAIAPWMASLYRKCPQLSSGTHYWSVSWLPESQREVLKDKNLNDDSALLGIGKRILSKFTQAVPSNVAFAANADDALFATICYLVANRNLAMISVWSPTFALQLLERLESLQQDVVEVLQSGKWGSRQASLKEVTAPHSSESAQALIASSNGEQIDFKKLWPKLSLVSSWDTAGSKAWAEKLKEKLPSVQFEGKGLWATEGVVTIPYNDQYPLAYQSHFYEFEYLEGEKQGQIVPSWQLKQGDVVSPLITSGNGLLRYCLDDCLKVTGFLEQIPCFEFQGRRFGVDLVGEKLAPETAQQLLSQLNETESKAISLLAIDTQQQVKPFYCVLFEGDIHHSINNEYIDSILRQNFHYELARNLGQLDQPQIRQANNGWNAYKKLVMFDGIIEGNIKPEPLKKVTLNSLEQL

SEQ ID NO: 7209 - protein, 74 aa, Acinetobacter baumannii
INNPCFASIVSSYLEENKRTNCPVLNIKFCDKAYLALGLRMVHMYSHNLTCIYNFMHIKIAYLIKKMQYLSNTS

SEQ ID NO: 7210 - protein, 495 aa, Acinetobacter baumannii
YHDPTWCNIEFWCKYWLYFGALHKEWGFHLCLRREKTYNTRIQVERRFMKTPKVGFVSLGCPKALVDSERILTQLKTEGYQVASDYDGADLVVVNTCGFIESAVQESLDAIGEAMSENGRVIVTGCLGKDEDKIRQMHPNVLKVTGAAAYQDVMEAVHEYVPAPPKHNPFIDLVPEQGIRLTPKHYAYLKISEGCNHRCTFCIIPSMRGDLVSRPVGSVLEEAAALKRAGVKEILVISQDTSAYGVDTKYKLDFWNGQPVKTKFFDMCEALGQLGIWVRLHYVYPYPHVDAVIDLMAQGKILPYLDIPFQHASPRVLKLMKRPAHSENTLEKIKLWREKCPDLVIRSTFVVGFPGETEEDFQILLDWLVEAQLDRVGCFTYSPVEGATANDLPDHVPEEIKQERYERFMQVQQQISAAKLQKRIGQTMTVLVDSLEDEYPVAVARSYADAPEIDGNVFVEDIDKSTIQPGDMLEVEITDADEYDLFAKLIKIKSV

SEQ ID NO: 7211 - protein, 60 aa, Acinetobacter baumannii
HVHPMPLRAYFGANAQRPETQEGPQFPLAFYLRQVDLNSSARQPNACYWFELTSLTKPSA

SEQ ID NO: 7212 - protein, 163 aa, Acinetobacter baumannii
KGVPMRSLHQVAASEIAVIPYYLKGYQQHGLQYGINEYERAEPLGAQCTNCHTILWITGRNDPILNEDDSNIPDSGPIYREYYKNKLKRFLSSLPLCPNCHQQAYDLFINNTTLTRFEDGSPAPKYPEEYYGVDEEMSALMKDKAVWWYGNQAEAKRLNLKLL

SEQ ID NO: 7213 - protein, 376 aa, Acinetobacter baumannii
HAAFQGIGMQQQSNMQNKFLIDAEIGDDDVTLPNLPAIDVPIVESPVKQEVKAEEVVEAAPSTEPEQPKSGFFGRMKEGLSKTRRNFTDGMVNILIGGKEIDDELLEEVEEQLLVADIGVDATKTIITNLTERTARGDLIYSHSLYKALQEELVALLAPRVKPLHIDPNKSPYVILMVGVNGVGKTTTIGKLAKRLQGEGKKVMLAAGDTFRAAATEQLQIWGERNDIAVVAQGHGADSASVIFDAFESARAKGIDVLIADTAGRLHNKSNLMEELKKVKRVMQKIDATAPHEIMLVVDAGTGQNAINQVQEFDQAVGLTGITITKLDGTAKGGVLFNIASRTHVPIRFIGVGEKIDDLRPFSAKSFVAALFETEK

SEQ ID NO: 7214 - protein, 532 aa, Acinetobacter baumannii
GDTLMISESVVDLSRFQFAMTAMYHFLFVPLTLGLAFILAIMETTYVISGKEIYKDMTKFWGKLFGINFALGVTTGLTMEFQFGTNWAYYSHYVGDIFGAPLAIEGLMAFFLESTFIGLFFFGWDRLSKVQHLGVTWLVALGSNMSALWILVANGWMQNPVGAAFNFETMRMELVDFGALIFNPVAQVKFVHTVSAGYVTGAIFVLAISSYYLLKKRDLPFARRSFAIAAIFGLASTLSVILLGDESGYELGDVQKTKLAAIEAEWDTHPAPAPFTLFGVPNHEEMRTDYAVKIPYALGLIATRSTTKEVTGLKDLMQQHEVRIRNGMLAYAELEKLRAGDRSPELLASFEKNQKDLGYGLLLKKYAPNVVDASEQHIQAAVKDTIPNVTALFFSFRAMVASGFLMLLLFILATWAVAKRNAENKPWLLKYALFALPLPWIAAQTGWYVAEGGRQPWSIGEILPTHLSASSLSTGDVWGSILALAAFYTVLLIIEMYLMIKFARLGPSSLHTGKYHFEKQEPKAAVNGEALS

SEQ ID NO: 7215 - protein, 216 aa, Acinetobacter baumannii
AIMPSNTDMNQLKRLSFVVTLSCLCSSLVFAESIDCSNSKAELKICSKTFSEARKQLNNKYLSAYLVTDAPLQLLQDTQTLWLRQTQQCKTNSCIQQQFDVRGDDLNFYASLKQTLTQHYLKFENGHIASQPVHLQIHQLAKDKIKIEGLAYRNPNNRKETQTVSLMAYSSPEQKSEILDNEHNCKYKFDFQKALLIVKTQQKGCERFTGIYRLYD

SEQ ID NO: 7216 - protein, 182 aa, Acinetobacter baumannii
RIFTMIETERLILRQWKESDSEPFIKMGLDEDVMRFFPKLLSATESISLIQRISALIDENGWGFWAVGLKETQEFIGFIGLHNQPEQFDFSPCIEIGWRIATEHWKKGYATEGAKAALDYAFNILNKDKVVSFTATVNKPSQAVMERLGMRKVKYFNHPRLPDEHALQKHVLYEIYHPKLEL

SEQ ID NO: 7217 - protein, 391 aa, Acinetobacter baumannii
MNFTLNSQNSLPDDATQGCLIGRAWIPSQISGPSPIILRGNQVFDISEKFHTISELLESADPLKALSEIEGRRVGSIDELFANTIAEPDTNKAYFLAPIDLQVIKAAGVTFAASMLERVIEEQAGGDAQKAQSIREVVQGVIGDNLKTIEPGSEKALQLKEYLIEQKMWSQYLEVGIGTDAEIFTKAPVLAAVGTGQNIGIHPKSEWNNPEPEVVLVANSQGKILGATLGNDVNLRDFEGRSALLLSKAKDNNASCAIGPFIRLFDHTFTLNDIRTCDVELQIQGTDNFVLNGVSSMSQISRDPEDLIQQTLNENHQYPDGFVLFLGTLFAPTQDREQAGAGFTHKVGDVVRIHSPKLGTLYNTVMTSDKATPWNFGINALMRNLKQRELL

SEQ ID NO: 7218 - protein, 327 aa, Acinetobacter baumannii
NMKFATLKNGTRDGQLVFVSRDLKFARPIPEFAQTMLQLLEQWDEWENGLYEAYELFNDNPDQNGFVFDTQKTLAPLPRCYQFVDGSAFLNHGRIMKEAYKIKNEEPEGIPILIQRQSDDFRSGVDDYTFPSTRDLCDFEAEFAVAVSDIPMGSSKDTIKSSIKLVMILNDVSMRGILNREIKMGFGFIQAKTATIFAPVAVTPDELGKAWENEKIALNIEVKRNDQWFGAPNGKEMDYSFSDLISHLVYNRNIKAGTIIGSGTVSNKDAKHTGSACLAEKIALEVIEHGAAKSEFIQYGETIEINVFDKSKKSIFGAIKTKFIPYS

SEQ ID NO: 7219 - protein, 83 aa, Acinetobacter baumannii
NKITLILGIQFIPLLKNKSNLFYRVCKGMLFSNVDYTPYLYQLKNNMLIIHTQCKQQKYKCDKYHIYILFNFKIMFFSNKFYF

SEQ ID NO: 7220 - protein, 199 aa, Acinetobacter baumannii
KMSTFLDKIKNRRTIYAIGKNVALDRTKIEETIREAVKHSPSAFNSQSSRVVTLYGESHAKFWNLVREALRKIVPADAFAGTNAKIDSFVAGVGTVLFYEDQAVVKSLQEQFELYADNFPVWSEHSSAIAQFATWTALSELGLGASLQHYNPIVDADAAEAFDVPATWKLRAQLVFGSVEAPAGEKAFISDEDRFKTFN

SEQ ID NO: 7221 - protein, 318 aa, Acinetobacter baumannii
IMTTLYDVVVKNRHVEGGNIAVMEFESATSAALPKVEPGAHIDVHLPNGMVRQYSLCQNPNDEGKFRLGILRDPESRGGSISAFDEIKDGMQIQVSEPKNLFPLLKAKHSVLIGGGIGITPLITMAYQLAHEGASFELHYCGASPEKCAFVDEIKNGELAKYTTFHFKSEGASHRAFFESAIKDIDPESHIYTCGPVGFMDWVINLATTHDFPEQQIHKEYFQVETDTSGDSFEVVAERSGKIIMVEAGETILQALAKEGIEIEMSCEQGVCGTCMCDVIEGEPDHRDVYFTDEEKASNEQILVCCSRSKTPRLVLDI

SEQ ID NO: 7222 - protein, 65 aa, Acinetobacter baumannii
GFATLHILVSHLIFTVTIVWLSLLSIPNKYQCLTQCCLLPLYKALSTLLKTNIQISNHTQLPGYF

SEQ ID NO: 7223 - protein, 433 aa, Acinetobacter baumannii
IVNTLLVNANKVNFFKDMHVKIDTDVNTGYGKDTDKNGYANIKYRELIQKLTATLSLTLLSFGWGSTVNAAQQQIALVGTWTSIPDAPLVQKPEKASEGLYQLQVNADGTLTPVKVLQMKSPSWVVKSKDGRFAYTTNEENEGAVTALSVQNGKVEVLNTVNSHGGHPTHASISLDGKFLFVSNYSAFDKGRGGVAVLPILPNGHLGEMVQNIVFAEGSGHVKGRQDSGHAHSTTFSPDGKYLYASDLGNDKVYAFRYNPSKSQPLEADKSRDVSFKHGSGPRHMVFSPNGKQAYITAEMRSEIVTFNVQEGHLKKVAELKLVHEDKTPEFKSASGIILSPNGKYVIAANRGADNKLLVFKIQQNGLLGQPQVYKANGIEPRAFSFDESGKYLYVTNVYSNNISLFRFDTKNGSLKPLGDAAKISTPTDIKFF

SEQ ID NO: 7224 - protein, 567 aa, Acinetobacter baumannii
GQSTVKLPNIVGRFRLDCTRNLMTHFIFVTGGVVSSLGKGISAASVAALLEARGLKVTMVKMDPYINVDPGTMSPFQHGEVFVTEDGAETDLDLGYYERFLRRAKMTKLNNFTSGRVYQDVLNKERRGDYLGGTVQVIPHITDNIKERVLRAGEGYDVAIVEIGGTVGDIESLPFMESVRQLMVELGHKRTMLMHLTLLPYIKSAAELKTKPTQHSVKELLSIGIQPDILICRTEYDVDADTKRKIALFTNVEARAVVVCKDAKTIYQIPRGFYEQNVDDLICERFGFTDLPEADLTDWDNVVEALLNPEYTVRVAMVGKYVELPDAYKSVNEALLHAGIKNRVKVQIDYVNAEELESQDVSILKTADAILVPGGFGERGTEGKMKAIQYARENGIPFLGICLGMQLAVIEYARHVAGMPEASSTEFNRSTKYPLIGLITEWLDERGELQQRSLESDLGGTMRLGAQKSELVEGTKTREVYGKAEITERHRHRYEMNNRFIEAIEQAGMKISGYSSAQHLVETVEIPEHPWFIAVQFHPEFTSSPRDGHPLFASFIDAAKTQHQKSK

SEQ ID NO: 7225 - protein, 459 aa, Acinetobacter baumannii
IYFTTKFARYLFKMSPTSSFWRSLFRLIHIYAGIFIAPFIFVAAFTGLLYAITPQLEQFIYKDALNVQPLNNEIYPLSQQIESARKVMPATAKITEVRPSPSPVQTTRVIFSDHTHHLNNEAIFIDPYTLSVKGQLAVYGTSGVLPLRTFLDQLHSNLLLGKWGRFYSELAASWLGFLTLSGLYSWWKRRSNFKNRQTNKNHLLKWHSSIGLALLPLLLFIAITGLTWSQWAGDNIRIARQWLNWQTPTLTTSLNQISLPEMSHHEHHEMIMETPNLDIMPAEFDSVLAIARANGINSTEIQIKPPVAENQAWTVAEIQRKWPTQADSIAIDMHEHKVIDKLAFKDYSLVAKLTRWGVDAHIGVLFGWVNQLILVLYALGLCVMIVYAYKAWFKTSNVKLTTHHFINQTLFVWKHATTQQRIITTLMLAILGLSLPIFGFSLVITLFILLIKKQLPLKA

SEQ ID NO: 7226 - protein, 109 aa, Acinetobacter baumannii
VMLTFKENFLKLKSELKADQCFNLVVIIIIGCIFMLSYLALLRPVNSEQYQRIVQLSRQATYPRTQDMAELIMAQSEIHRAEYLKLMHAYQFEHDHIKQYPALAQEDTQ

SEQ ID NO: 7227 - protein, 141 aa, Acinetobacter baumannii
RSITMNDEQRYKQGIEVRTEVLGEKHVGRSLQNLNDFNQDFQNFISRYAWGEVWSRPGLPRHTRSLVTIAILLALGREDELRMHLRACFNNGVTKEDLKELILHSSLYAGLPAANAAMHMAEEVFKELGIEVNPIAAKEQD

SEQ ID NO: 7228 - protein, 126 aa, Acinetobacter baumannii
KMVTRRIMSNKNIFIAKTSELSQSTAKGISLDGVNDQLFLVMTDTEVAVWVNDCPHNHRPLEYQKDKFLSADGNHIVCYAHSAHFDKVSGECFAGPCKGKKLRKIQHHVIDGEIYVESKILIDLKD

SEQ ID NO: 7229 - protein, 532 aa, Acinetobacter baumannii
LHSTCRPVSTKQISVNKYQIYFWRARMLDQSKEIKVCTYLGLTTLILSVALVGCGGGSSSGGSSNTPKPSEPTPEVMTDITLKTPVEMRNVQLKVYDNTDNSILIDTQVASLTSYDIKLPSTKLNRLYRVEVTTQGSSQVFDPTKSEYQNISGVYHAFITPSSISNKTQLISPSSEAIYQRAVIRSGQLPNETIIPTRIEQLHVDLASQDVYRSLLNAFKDTNIPSLSPASTLTILNLLKYSTTKPSTYVDSYLSFGYLQYWSSIHNTNSPYQDLTQSLATDLKDGYLDGKKLIGDKTSFTPIFTSAPDNIDPAKNTLLDIAANQKVTRDYFATNLRAATFKLADLQDQSHLDPIGYDLLDKKQYSGIIPAGNTSEFFRIDGAGDYRRAVGFSGITATCNGSAYPCKQGLTSINISDPKLPATDYLVGHYEDSTTGCQLNFRANGQIELIKSSQSYRSALSADSTDNLLQTDAASYSYLLNSSSSEPNNSTQQYNFIQLNIKANKIVSAQAGLDSRKAPDVLQTTQLECSFS

SEQ ID NO: 7230 - protein, 76 aa, Acinetobacter baumannii
GHFLCSMKLKQMACWHFNNLINSDFLDSAAYIVEVASFKPNPKNKMPTKKIPLAAILWFCLKKVESLIPEKISAVK

SEQ ID NO: 7231 - protein, 300 aa, Acinetobacter baumannii
FLLTSSFLELNLKEDWSKKMKTALNRTPASFPVRRMDYNFEDTPRYWCNHEPSLTHYFTGLSTLFPEGESYFVRSVRALRAKAKENEILDREIGAFIGQEAMHSKEHHAFHVSAQQYGLNPESLEKATGIVLKAIEKVFSKKWNLLVTVGLEHYTAVLVVSMMQSVNELMTNNTIRNLWLWHSVEETEHKAVAFDLYQHLYGNGLDAYIPRVGIFTFSLVLITAFSTIYHIVLMKRDKQLTNFKTWRNFFKFASKQYKVLIPKFLEYYRFDFHPNQTDEKALVAATKVKLGINDRSLLLS

SEQ ID NO: 7232 - protein, 84 aa, Acinetobacter baumannii
ACLTRIEPLPLSPPLPMKSASSFPTKSPFEVGLTISTPTREVAAETFNDLLLEFELSNGIDPVLFAIERVEPSKSYAASTRIFP

SEQ ID NO: 7233 - protein, 82 aa, Acinetobacter baumannii
VDITFNVITATLISEVAFFYLRRANIVEQINYANARSQFSKVMERVLLGYAVKITRKEKDAVVLISEKHTLNIKMQCLSSIN

SEQ ID NO: 7234 - protein, 324 aa, Acinetobacter baumannii
LLITSGYQKGILKMADLTYSSLNNWLKFKHLVLLETLARTNNMHLAAEQMNLSQPAVSKMLKEIEGLLGFQVFERLPRNMPVTALGEHVIRYAQRVLNDAKHFVEDIEILRLGGHGFLKVGGIFAATAVVIPNSIIEIKKQWPLLSIDVVEQTSDHLMEMLSEHTLDLAIGRFTDVTQSQFFDFQPLGPEPFCIVVNNAHPCAQKKFCTLEELLKWPWVLYPKGTPIRERMEGAFARAKVKIPLNTVNTMSMQTFLQILKGAPMVGMLPEAMVIDQVKEGQLQILETDLILDAQDYGILTRKDEPVSDIAAAFINILLKNAKRK

SEQ ID NO: 7235 - protein, 117 aa, Acinetobacter baumannii
RRPTMSVLIEFVSATVHTENLRSVGVKVMSLFLLHKKVTSELTNFSVSAMRAFRMRGLAFFICFYDFAMHWVSSTSGKNGFQAAIRFVMLIRFSVEHKAKQQCLFENARTQLKSNVI

SEQ ID NO: 7236 - protein, 446 aa, Acinetobacter baumannii
FGTTMKGMKPFNTRFLTLRHALFLGVLVVSNTHAMTLDEALSASLRHESQLEVSRLSVNQSTAMLEQAKQRDGLKVNLVGQLDYERINTPSHVLFPTEGNRKGRSLQLQADYPIYTSGRHRLGIDIAESQLSAQHQGLSDQRSETILNTVMVYTDVLKKKAILELRQKTMANLQRSLYESKRRFDVGMITRADLAQVLAQVAQGQADITQAQSNLTVSEAQFYQVTGITPDNLVPINQLPTIPANLDEILAQTKNHPALMRAKYEKQAAEKQYALTKRELWPTVMLTSRAGKQDEASYIGSESNNYMVGVQLNVPLYDDGLNRANIKKAQADIDLAAQKIRSLELDLNKRTRTTYAQLQTIRQNKDALANAIEAASIAFVYTRKEFDVGTKTTFDLLNTEQKLLDAQTQKTVNDQDEVVFVYQLLDQMGRLNNLVPMQTAQQVNNE

SEQ ID NO: 7237 - protein, 541 aa, Acinetobacter baumannii
TKTTFQDTLINFRIFVMTIIGQNFIGGSRSAQGTTLLKSIHATTGEALPYEFHHATEQEINQACEAASQAFKTYRHTSPEQRAVFLENIADELDALGTDFLEIVSQETALPLARLQGERGRTSGQMRLFAKVLRRGDFLGARIDTALPERQPLPRPDLRQIKIGVGPVAVFGASNFPLAFSTAGGDTASALAAGCSVVVKAHSGHMATADFVAQAIERAVEKSNMPKGVFNMIYGNGVGEPLVKHPLIQAVGFTGSLRGGRALCDMAAARPQPIPVFAEMSSINPMLMLPDALKNRGEKIAQDLADSVVLGCGQFCTNPGLILGIKSAEFSQLISNLTDIMGAKPAQTMLNAGTLKSYTAGLEHLTQHQGIKHLAGQTQQGNQAQPQLFKADVELLLAGDQLLQEEIFGPTTVIIEVEDKAQLIQALQSMNGQLTATLIADEADLTEFAEVVPVLEEKAGRLLINGYPTGVEVCDAMVHGGPYPATSDARGTSVGTLAIDRYLRPVCYQNYPQSLLPEALKDSNPLLILRLVNGEMTREAI

SEQ ID NO: 7238 - protein, 1040 aa, Acinetobacter baumannii
GGATMMSQFFIRRPVFAWVIAIFIIIFGLLSIPKLPIARFPSVAPPQVNISATYPGATAKTINDSVVTLIERELSGVKNLLYYSATTDTSGTAEITATFKPGTDVEMAQVDVQNKIKAVEARLPQVVRQQGLQVEASSSGFLMLVGINSPNNQYSEVDLSDYLVRNVVEELKRVEGVGKVQSFGAEKAMRIWVDPNKLVSYGLSISDVNNAIRENNVEIAPGRLGDLPAEKGQLITIPLSAQGQLSSLEQFKNISLKSKTNGSVIKLSDVANVEIGSQAYNFAILENGKPATAAAIQLSPGANAVKTAEGVRAKIEELKLNLPEGMEFSIPYDTAPFVKISIEKVIHTLLEAMVLVFIVMYLFLHNVRYTLIPAIVAPIALLGTFTVMLLAGFSINVLTMFGMVLAIGIIVDDAIVVVENVERIMATEGLSPKDATSKAMKEITSPIIGITLVLAAVFLPMAFASGSVGVIYKQFTLTMSVSILFSALLALILTPALCATILKPIDGHHQKKGFFAWFDRSFDKVTKKYELMLLKIIKHTVPMMVIFLVITGITFAGMKYWPTAFMPEEDQGWFMTSFQLPSDATAERIRNVVNQFENNLKDNPDVKSNTTILGWGFSGAGQNVAVAFTTLKDFKERTSSASKMTSDVNSSMANSTEGETMAVLPPAIDELGTFSGFSLRLQDRANLGMPALLAAQDELMAMAAKNKKFYMVWNEGLPQGDNISLKIDREKLSALGVKFSDVSDIISTSMGSMYINDFPNQGRMQQVIVQVEAKSRMQLKDILNLKVMGSSGQLVSLSEVVTPQWNKAPQQYNRYNGRPSLSIAGIPNFDTSSGEAMREMEQLIAKLPKGIGYEWTGISLQEKQSESQMAFLLGLSMLVVFLVLAALYESWAIPLSVMLVVPLGIFGAIIAIMSRGLMNDVFFKIGLITIIGLSAKNAILIVEFAKMLKEEGMSLIEATVAAAKLRLRPILMTSLAFTCGVIPLVIASGASSETQHALGTGVFGGMISATILAIFFVPVFFIFILGAVEKLFSSKKKISS

SEQ ID NO: 7239 - protein, 99 aa, Acinetobacter baumannii
IMATAMTASNQRKAQAFAMAISFLLALPLAVILLVHPSLMLDANGHYNHSQLMLVMVGISGGFIYGVGFVPHFWLWKWLFSPWIAWPLMLLGYYIWFLT

SEQ ID NO: 7240 - protein, 189 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTFPDLDQTMNVSHTTIYSTIRALPKGELKKDYYPVYVMKIKSEKLTVNLKKILYYRILKLFMSAQPKFKKEKYRVIGKLI

SEQ ID NO: 7241 - protein, 141 aa, Acinetobacter baumannii
NEKTRVCIWPTLPDAKAESVRKLLTEALKYYLAELRKTLTYDRGREMSEHKILEEDLGIDVYFCDPHSPWQKGTCENMNGLIRQYLPKGIDLNQADQHYLNQVAMSLNTRPRKALDWLTPLEKFAQLVDYHMAFETVAPHV

SEQ ID NO: 7242 - protein, 163 aa, Acinetobacter baumannii
NIMTESTTPKFAIPELPMQIQTIRQYLPHRYPFLLVDRVTEVTDNSIVGYKNVSINEEFLQGHFPEYPIMPGVLIVEALAQVSGVLGFIMNNETPKPGSLFLFAGAERVRFKKQVVAGDQLVLKSELVMQKRGIYKYNCTASVDGIVAATAEIMISHQKTEQA

SEQ ID NO: 7243 - protein, 125 aa, Acinetobacter baumannii
PLMTMLNFSKIFRRNVLEMERICMTEEVPEREARAFDTLQGTTIFITQRDGSFYAYQNLCPHLQTELEYLENQFLDQDQEYIQCSTHGALFNVETGECISGPCLGEFLNKVEIKVHSDGGIYIVD

SEQ ID NO: 7244 - protein, 331 aa, Acinetobacter baumannii
ISMTHTALDQLKTLTTVVADSSDLEAIRKFRPLDATTNPSLITAAAEQPESKELIEDAYYQAKEEGYKNDELIERTIDILTVKFGVEILKLIEGRVSTEVDAALSYDTEATIQKAHELCELYKGYGIDQSRILIKIASTWEGIQAAKVLEAESIACNLTLLFGLHQAQACADAKVTLISPFVGRILDWYKKAEGVDSYPIEKDPGVVSVKKIYTYYKQQNIPTQVMGASFRSIDQVLGLAGCDLLTISPSLLTQLEQDTRTVDAALDANKAKQAEAIVRPAQDEQSFKDELNHDLMAFQLLQGGVDGFIKARDQLSLLLRQSFGIDAEIKS

SEQ ID NO: 7245 - protein, 151 aa, Acinetobacter baumannii
MSSTILVIHGPNLNLLGKREPEVYGHLTLDNINQQLIAQAEQASITLDTFQSNWEGAIVDRIHQAQTEGVKLIIINPAALTHTSVALRDALLGVAIPFIEVHLSNVHAREAFRHHSYLSDKAIGVICGLGAKGYSFALDYAIEKIQPSNPN

SEQ ID NO: 7246 - protein, 149 aa, Acinetobacter baumannii
NNRTEEMTIVAQVIKNKSEQAIFTISPEATVLEAITIMAEKGIGALVVAEGEQVVGILSERDYTRKVTLMERSSYSTTVAEIMTAKVITVGLNNTVEECLQLMTDRHLRHLPVLDNGKLVGFISIGDLVKAAMEDQKVLIEQLKQYISG

SEQ ID NO: 7247 - protein, 318 aa, Acinetobacter baumannii
ITFAEIAQMDLTNSIDIRTLRFFISVYNAQNFSNVARKEDVSASMISRTIQQLEDALGQQLFYRNTRAITPTESGKLFFEYAKRITEQFDEAQKALQDKTIEPSGLVRINAPVFFGQRHIAPWLAGLSERYPRLLIELIQTDEFIDPLRESTDLIFRIGALTDSSFHARIFGTQNYHLAASPQYVAKYGTLDHPTELNQHKCLVYKGFEGPNRWLVRKSNEEWVHYPITPLLSSNNAESLMTAALHGMGIVLFPDWLIGEALKQGDLIKLLPEYEVAIKSHPQHIAAIYPNVRHPPLNIRAVIDYFAEIYGDTPYWQS

SEQ ID NO: 7248 - protein, 445 aa, Acinetobacter baumannii
SRVAGTFPGMTQDIFKRTIDMNSIIPTHNIGIDYDALVKSDRAHTSLYKDERIFDEEMEKIFYSTWVWVAHASEIPEGGSYKTINIGKQPVVVVRDRKKKVHVLLNRCRHRAATVCEHKKGKTNSFVCPYHGWSYALDGSLRGVPSPESYGDCLDKSELPLVSLRVEEYNGMIFASFKEDIQPLEEFLGPAKKWIDLFMKQGAGYPIKVLGEHRFRFPGNWKIQLENTTDAYHFPLVHKSFLSSVDEKTEELFNFENQPGFVEDLGNGHSVMVMIPELVDLEEDLMERPIQERFEDLAQALRDEGHEELEVRRIVRAVGGSGFNLNLFPNIACSMAFFRVLQPISVAETEIHHSVITMDGGPQIANQYRLRLHEHFQGPFGFGTPDDSEAWERVQHGANAGNDLWIMLNRGLPGEVKTEDGLKSDVSAETGMRAAYQQWKKMMTA

SEQ ID NO: 7249 - protein, 182 aa, Acinetobacter baumannii
NTYLFFSLSGWNKFLMEAQYKVLCVCLGNICRSPTAEVVFRHYCDQHQLNIIVDSAGTSNYHPNKAPDQRSQLHAKKRGYDLSSLRARQLSTQDFLDFDLILAMDHQNFDDIHDLLQRAIFQFGSHQIRAKVALMSEHDPQYPQQALPDPYYGGDEGFERVLDQCESSALAWINILKKQLNV

SEQ ID NO: 7250 - protein, 342 aa, Acinetobacter baumannii
SVGAINMEKLKYYWFYPLPFIMIFISLLIGPTQTLSAWDYLRWGVQAVFGTPYFDAEQFRLMQNIFVNVRLPRILLTFMVGAALATAGNGLQALFRNPLVDSYVLGISSGAAFGAALALSLSWLSPNLSAFVFGVCAVALTYLFAHQKHESQTSLVMVILSGMIVSGLFLAGLTVIQYLSDPFKLQAIVQWTMGNLHQASWQKVQYAVLPICIGLAGLFAMRWRLNLMALGAEEAQAVGVNPRWEQLLLIALVTVCTSTSVAAAGIISLYGLFMPHIVRMLVGPDHRYSIPANMALGGSFLLLIDNFSRVLLTFEIPIGIFTMLLGAPFFLLLMKTQRTHWA

SEQ ID NO: 7251 - protein, 115 aa, Acinetobacter baumannii
LPYFSFTVMYAYIYGCHDCIVFRKKTDIAKSAKGSKSSLGFRNKRFNQKRPLMVSFLIYKELKFPYLKTHSIRGPAQSYLSKFTILDHPILWAKSKGIINCLFLTNLLTFNLKSS

SEQ ID NO: 7252 - protein, 85 aa, Acinetobacter baumannii
PKIAGKTPSGSSPDNVKASVWHTPVWVIFIKTSPALGGATSTSTISKGFPGAKATAARDFIFGFPLYHSVLIVEQNRLCNRNTRA

SEQ ID NO: 7253 - protein, 240 aa, Acinetobacter baumannii
TMSALLEKDFSPTEFTLFSEILWKLGSGKGQYNLRENIIADIAILLRADFAASYIWDSTHNLSKDGVIWKIDPKAMEDYECIWQFDDPITAQLHKLQKPTFVNEVMPLSDLKKTGYYNEFLKTYGLYHGINIYFVRNGVDIGDLRIWRAQDAEMFGEREKRILTLLEPYFTQALPLDLSTQYGLTPREQEVVHLVSKGLSDKEVASLLGIGFTTLRTHLNNSMRKIGGNNRTEMALLIQH

SEQ ID NO: 7254 - protein, 71 aa, Acinetobacter baumannii
NSYLVGEIVVSENTKGEKVAVLKTNKINCNLFISMEAQMKVSKSLYYNTKFNIGLKNNISKIYIFLIFKVV

SEQ ID NO: 7255 - protein, 856 aa, Acinetobacter baumannii
ADLAMPKKRQESYKLLKRHICYYLASGVVTMTMPVFVHAEEAAASAPVEAEFDSAFLIGDAQKVDISRFKYGNPVLPGEYNVDVYVNGQWFGKRRMIFKALDPNQNAVTCFTGMNLLEYGVKQEILTKHAPLQKENNSCYKIEEWVENAFYEFDTSRLRVDISIPQVALQKNAQGYVDPSVWDRGINAGFLSYSGSAYKTFNQSGDRSETTNAFMGVTAGLNLAGWQLRHNGQWQWQDTPAENQSKSDYQETSTYLQRAFPKYRGVLTLGDSFTNGEVFDSYGYRGIDFSSDDRMLPNSMLGYAPRIRGNAKTNAKVEVRQQGQLIYQTTVAPGNFEINDLYPTGFGGEIEVSVIEANGEIQKFSVPYASVVQMLRPGMNRYSLTVGQFRDQDIDLDPWIIQGKYQQGINNYLTGYTGIQASENYAAILLGAAVATPIGAIAFDVTHSEAEFEKQASQSGQSFRLSYSKLITPTNTNLTLAAYRYSTENFYKLRDALLIRDLEEKGVNTYAAGRQRSEFQITLNQGLPEGWGNFYVVGSWVDYWNRSESTKQYQIGYSNNYHGLTYGLSAINRKVEYGSNDASHDTEYLMTLSFPINFKKNSVNVNVTASEDSRTVGASGMVGDRFSYGASVSHQDYANPTFNANGRYRTNYATVGGSYSIADSYQQAMVSLSGSVVAHSDGILFGPEQGQTMVLVHAPDAAGAKVNNTVGLSVNKAGYAVVPYVTPYRLNDITLDPQEMSSEVELEETSQRIAPFAGAIAKVDFATKTGYAVYINSKTADGNSLPFAAQVFNQKDEAVGIVAQGSMIYLRTPLAQDSLYVKWGDESNERCSVEYNISNQLRNKQQSIVMTEAVCK

SEQ ID NO: 7256 - protein, 479 aa, Acinetobacter baumannii
IASAREFFNQITEVSMQTRIEHDTMGEIEVPNEALWGAQTQRSLQNFKIGQERLPRAMIRAMGLVKKAAAITNAELGQLPQDLSQYIVGAAEEVIAGKWDSQFPLVVWQTGSGTQSNMNCNEVIANIANQKLGQALGAQKPVHPNDHVNRAQSTNDSFPTAIHVAASLQINELLIPAVEQLKATLQKKSDEFQDIVKIGRTHLQDATPLTLGQEFSGYVSQLEHGLVRLQQALSGLYELPLGGTAVGTGLNAHPDYAVKAAAQLAALTGLPFVTAPNKFEALAGRDAAVFASGALKTLAVSLNKIANDIRWLASGPRCGFGEIRIPENEPGSSIMPGKVNPTQSEAMTMVVAQVLGNDTTINVAGASGNFELNVFMPVIAYNLLQSIQLLGDACNSFNDHCAVGIEPNREKIDHFLHNSLMLVTALNPVIGYENSAKVAKTAYKENKTLKQVAVELGLVTAEQFDEVVKPEKMVSPNSK

SEQ ID NO: 7257 - protein, 285 aa, Acinetobacter baumannii
TNSARENREIIMLERIVTALVLVAVVLGCMFATQSHYPMLVLMIVAAGVAGYEWYKLMPREVGAVVKPKAWGYGLLVAFVSGVALFFHDIALLLWSASILTWLVSVYWVKSFPEFDGWYNATLYVIGLILICAAVTAIFVVWQSSPWWLMYLFLLVWGADSGAYFVGRKFGKRKLAPTVSPNKSVEGLYGGILTTIIVMLVVQYQYLNLTWVQQLLFLILSLTTVFGSVLGDLFESMIKRRAGIKDSGRVLPGHGGVLDRIDSLLAAAPIFATGMYILKLIGVDL

SEQ ID NO: 7258 - protein, 217 aa, Acinetobacter baumannii
SLPARGRSVNKGYPITDLVILAGGQARRMNGLNKLLQQFDGDTQLLKIHQKLKSSVSEIWVNSHRDYSIYQSIVPDIKCFQDDASGFFGPLMGMKSTWSHVRADYVLFIPCDVTYIPTQVVAKLHSALRKNKQAQAAYVSINGDALYPFCLLKRESLEVLEQQIDKQQLSLKNCFKLLHAQVAIFQKQNLFFHSINSLDELQQYKQIKAFKEIFSTN

SEQ ID NO: 7259 - protein, 167 aa, Acinetobacter baumannii
SFLAMNMLNYQLVGKTDYESAVEFALYTRQLLFPEIYHGQIPKDLKNFEQHYVHDPLGCFITVKDQNRIIGTIAYRAYDHRFDLNLPSNTVEVVKLFVLPEYRRKGIATQLCDMLFSHAKNSEITTLYLHTHPFLPAAEEFWRLQGFEVIQREWIDTYDTIHMSKSL

SEQ ID NO: 7260 - protein, 73 aa, Acinetobacter baumannii
EKMAKRKYKSDKFQVRRINRQWWVLEKDLETNCYSKHEQVATKTLANNYADDYIEQYYMNLYIQQQLKKPETV

SEQ ID NO: 7261 - protein, 62 aa, Acinetobacter baumannii
LLMAIMLKMLKLGPFIYPKLFIKNKSYTNRSSIYSQPLAFISSNFLFNSSFVYSCESLAKRI

SEQ ID NO: 7262 - protein, 354 aa, Acinetobacter baumannii
IHLFILHSICARGAIMKLLASLLTLLILCGCSSSEQNRKTQENSTSHSICVFDSTNTKVCVAKPAQRIVSLFESGLDGLYMLGQGDKVIGIPAEVYIQPLLFNAYSKIDKRIANKQLAAPSQGANATNIESLVLLKPDLVIVGSGQTQTIELLRQFGIAVYVMESGTYKQVKEELSEIAILSGAQKRAQEILNFSDEIVAEVAAKTARQPNKQSIYYAWSGGRIFSTSGRESITNDFIELAGAYNIVQTNANQPNVNPETLIEWNPDNIVLWNTNPKLIYERKELQGLSAVQNRKVFNLSPAFIYNPHTIKIIITAIYLNHSIYPEQSDLPVSALQQRILTKLYGEQLAKALVQ

SEQ ID NO: 7263 - protein, 425 aa, Acinetobacter baumannii
MKNLFSQVMRGTLFVSFFSTVHASELEIKPTFDATFGTFSSGKSYNGENLHDERINWQEGHLKYGAKGQYTFKSNQLYASLSGISSATFGDGDAGQNSNGKERKTDVNEWVIGFKDGTNKDELKTYDLSIGRQNIMIGDGFFIAGDALNLGKAPADGTLDRGGAYYLAARRSFDFTSLLQYKPQENTTLKLAYLKSDNKAQFSPELFVTDLMYQLKDKGVGFTYLNVLDLTDAEHVSGREDLKNYALRLNYQPLPELQVKTEFVVQDKKDGQENAGYLALNYNFLSSKYTPSLGYRFSHFSDQYDPMFYGNTVGFGTWFQGEVAGNYAGPFNKNADIHQVSYSMNLKENFMLGALAYKFKTVNKSLTNIDGHELDVFSVWSVNKKFNVIPLVGLYKPKHDIHSGGTQNYDDKTNVYAQLILQYIY

SEQ ID NO: 7264 - protein, 362 aa, Acinetobacter baumannii
PEFYSTNYSKCEQWCKLIDLIFYSVTTHMATVDLFAIGNALIDQEFKVSDDFLSQQGLQKGTMQLSDGETQSALYEKLKQTQDYKGQASGGSAANTTVAFSALGGSAFYGCRVGHDELGGIYLQGLNDAGIQTTPKSISEGVTGTCMVLISPDSERTMHTYLGITAELSQDQIDFEPLKTAKWLYIEGYLSTSETARKAVKQAREIAKAHGVKIALSLSDPAMVQYAREGLEELMDDGVDLLFCNEQEALMYTNTTTVEDALTQLRFKNHTVVITQSAKGALVANPTHHFHVAGRHVEAVDTNGAGDAFAGAFLYALNHHEDLTAAAQLAILISSEVVSQFGPRLAINDYAKLLENFQKECA

SEQ ID NO: 7265 - protein, 309 aa, Acinetobacter baumannii
PAIYLGQFSTTTIRQNFSNCFCSRIKRTKMTIKLNPLNAIDFYKADHRRQYPAGTEYVYANFTPRSSRLAKMLPDFDDKVVFFGLQGFIKHFLIDTWNEGFFKQPKDKVVAAYKRRMDSSLGEGAVPVDHIEALHDLGYLPLRIKALPEGSRVNMRVPVLTVINTDPRFFWLTNYIETVLSAELWKSCTTATIAYEYKRLLTQYAIKTGAPLDFVPVQGHDFSSRGMSGIYDAAQSGVGHLTSFIGTDSVASIDYAEEYYNATGVIGVSVPATEHSVMCMGTEDSELETFKRLICELYPSGVVSIVSDT

SEQ ID NO: 7266 - protein, 101 aa, Acinetobacter baumannii
IGTYKMKNNIFKILVLAVFSTSPLFCYANNTIMIKGNIVEDTCSTKSNEIECNEVNNLNIKLDSEYLNKDSLYKLAQHTEKMDTSIESLGSNRKIILINYH

SEQ ID NO: 7267 - protein, 544 aa, Acinetobacter baumannii
RRTYMNIVQDKNMLPDDQWIDVCALDDLTPNTGAGALVGGQAVAIFRVGHEKRVYVLSNKDPFSQANVMSRGIIGDLQGERVVASPIYKQHFSLATGRCLEDKDQKLAVYPSKIVDGRVWVNAVPQKTYITNTGVSQDKLRLVLIGNGLAGMRCLEDLLDMAPDRYEVTVIGEEPWGNYNRIMLSPVLSGEKTIEDIMLHPPKWYDDKGIKFIAGDKAVKIDRPRKVVYTEKGQTVDYDRLILATGSAPFIPPVQGVDLKGVLTFRDIYDVNTMIEYCGSKTNAVVIGGGLLGLEAAYGLKQRGMNVTVLHLMDRIMERQLDGRASQLLRHSIEQKGIQIITEANTEALIGDENGHVKQIRLKDGTVLDADLVVFAVGIRPNIALAQSAGLRCNRGVLVNDTMQTFDPSIYAVGECIEHRGQTFGLVEPLWGQAFICATHLAEHGSLTFKAPTVPTQLKVSGVDVFSAGNFEPKDDYEDIILNDEKRQIYKRIIIQNDRVIGAVLFGDTEDGMWYAELIADQTPVSSFRNKLLFGRDFALKNAG

SEQ ID NO: 7268 - protein, 111 aa, Acinetobacter baumannii
ENNYSFVLMKKLTIQTQDRQQILIDLYKQYLLSEITLGQLLSYLRKNVLGLSQEQYANLVGISRRTLTDIELDKGKLTQSVLDKVFKPLGLKAGLVPTHEHIVSKIIKPNE

SEQ ID NO: 7269 - protein, 444 aa, Acinetobacter baumannii
CRNLHRVIHSTEELFMSQIVDIRAREILDSRGNPTIEADVILESGVVGRACAPSGASTGSREALELRDGDKSRYLGKGVRTAVQNVNSSIHELLVGQSVFEQKALDEKMIAFDGTENKSKLGANATLAVSLAAAHAAAAEQKLPLFQYIANLRGQTTLTMPVPMMNILNGGAHADNTVDIQEFMIEPVGFTSFAEALRAGAEVFHSLKSVLKKQGLNTAVGDEGGFAPNLRSNEEAITVILQAIEQTGYKAGSDIMLALDCASSEFYKNGQYILEGEGNKSFTSNQFADYLAGLVKQYPIISIEDGLDESDWEGWSYLTSILGDKIQLVGDDLFVTNPKILQRGIDEKVGNSILIKYNQIGTLTETLDAIYLAKANGYTTVISHRSGETEDSTIADLAVGTAAGQIKTGSLCRSDRVSKYNQLLRIEELTKAVYRGKAEFKGLN

SEQ ID NO: 7270 - protein, 144 aa, Acinetobacter baumannii
MQILLLLLTILGGMGLSVEAGLLGPLGKEVGELWATFSIFGVGAALTFLLMLFFSPRNSPSFFTLPSWQLLGGVLGPAYVIILTITTPIIGIAMTMIGILAGQISKSLIIDHYGLLGTPHRKVDRKRVVALIFIVAALVLVAKA

SEQ ID NO: 7271 - protein, 65 aa, Acinetobacter baumannii
LTSYKKYLTINGSEPALQLNKEIFIKLHKELINCYFIMKIIGQTIRLTVFDRDTFKIFCNTAYLH

SEQ ID NO: 7272 - protein, 458 aa, Acinetobacter baumannii
SVLYIRIKCMNQSNIAVERTQKKINAYAWYVVILCMLAYIFSFIDRQILALMIEPIKADLQLSDTQFSLLHGLAFSLFYAVMGLPLAYIADRFSRPKLISIGIIVWSLATATCGLSKNFIQLFLSRMAVGVGEAALSPAAYSMFSDMFSKDKLGRAVGIYSIGAFLGGGIAFLVGGYVINLLKGVTLIEVPLLGALKAWQIAFLVVGLPGIIIGLLFILTVKDPARKGQQLNQSGQVDQVKFTQCLQFIKKHAKTFACHYLGFTFYAMALYSLTSWTPAFYIRKFQLAPTETGYMLGTILLVANTLGVFCAGWLNDWFIKKGRQDAPMFTGVIGIVGLIIPIAFFTQTDQLWLSVTLLIPAMFFASFPLVISATALQMLAPNQFRARLSALFLLVSNLIGLGVGTTLVAIITDKVFGNPLMVGSSLSIVGGLSCVLALALLFKGCKSFSESMKLEKLR

SEQ ID NO: 7273 - protein, 83 aa, Acinetobacter baumannii
VVVYSSFTLNFKMSLMLIAVIKLNCTDRYSTILLNLRQFSILNFSMSYTKNEIAKYVCRVVCLIALKRMRKIKKFWMQQQSFF

SEQ ID NO: 7274 - protein, 232 aa, Acinetobacter baumannii
KYTYHIVKRSKLKVKYPYKSNFIMCANFKPLKREHSYQLDLLEPTFDYKSDVYPSDDCPIILSHQNEWKWRKVKFGMLPPYAKEVSFKYATYNARTETVDHKRSFKHAWSNDQFGLVPVEAIYEPKYINGKAHWYGIFRQDGKPFTLAAIYEETIIDEQKVRTMSLLTINADRHSFMKQFHKPDDEKRSIIVIPDHLRNDWLNCKHTDAPDFFLDMPLNEFTSLPKAEMNKS

SEQ ID NO: 7275 - protein, 273 aa, Acinetobacter baumannii
DYDFTPKNRAGMSNHDLIHSTAIIDPSAVIASDVQIGPYCIIGPQVTIGAGTKLHSHVVVGGFTRIGQNNEIFQFASVGEVCQDLKYKGEETWLEIGNNNLIREHCSLHRGTVQDNALTKIGSHNLLMVNTHIAHDCIVGDHNIFANNVGVAGHVHIGDHVIVGGNSGIHQFCKIDSYSMIGGASLILKDVPAYVMASGNPAHAFGINIEGMRRKGWSKNTIQGLREAYKLIFKSGLTSVQAIDQIKSEILPSVPEAQLLIDSLEQSERGIVR

SEQ ID NO: 7276 - protein, 694 aa, Acinetobacter baumannii
QGAYMYQVLARKYRPRNFNELVGQNHVSRALSSALERGRLHHAYLFTGTRGVGKTTIARILAKCLNCETGVTSTPCEVCATCKAVNEGRFIDLIEIDAASRTKVEDTRELLDNVPYAPTQGRFKVYLIDEVHMLSTHSFNALLKTLEEPPEHVKFLFATTDPQKLPITVISRCLQFTLRPLAVDEITKHLGAILEKEQITADQDAIWQIAESAQGSLRDALSLTDQAIAYGQGAVHHQDVKEMLGLIDRTIIYDLILAVHQNQREKVSQLLLQFRYQALDVSLVLDQLISTLHELALLQYLPELGLKYSEEINAKILQLSKLISAQDLQLYYQIACKGRSDLQLAVTQEQGFEMCVLRLLAFRPLAPNEILVSEPVQQNGQVEVGLNSQAQTAQEIAPVSAVQPVEVISQPAMVEPEPEPEPEPEPEPEPEPEPEPNQDLMVFDPNHHELIGLESAVVQETVSVLEEDFIPVPEQKLVQVQAETQVKQIEPEPASTAEPIGLFEASSAEFSLAQDTSAYDLVSEPVIEQQSLVQAEIVETVAVVKEPNATDNSQLMPQDILKLPSQNLEGEWTLEKWEFWFRNSQLSPAVQELAQHGVMTGEIGGNTVFHIPQEYENMLTQLQQALIEALKQQWPNTQFTVEYGAVNTATPYVMQSVRKEKAFHRATELLQQQPVIKSLIETFDGELQNIQLKP

SEQ ID NO: 7277 - protein, 74 aa, Acinetobacter baumannii
KVQYKLTITSFILRFAKALAALSCSGGIFLYLYKTKITYLSKALLRHFSRDLESPPYPAFICIDISTHQYLFTI

SEQ ID NO: 7278 - protein, 147 aa, Acinetobacter baumannii
TLEYLLRITAMKKNTKLDQDKLFIKLLFKSTSEVTDEEIEYYRKYPDQIDQVTAPLNIHKIFLWAGALLGVVVVAVAKFLKFSGSLDFLSEGVLEFVIDIIYETGIALIGAAVTAYMLGVLLNKQQENATKWREEIRRRIKESEGAL

SEQ ID NO: 7279 - protein, 166 aa, Acinetobacter baumannii
YSDLLTFIWASIEMNRLQLILLVLSTATFSPFVFSETTISPTKYEFYGQESKRHKSMLEVNNSSDHKINESQHNPFRSDSNKQNVDFFEIAKHYQEQQPQNTYSHSPDHTVNMSDHERSLYYIRNHDNMGLQRDVRYQQYRSLKQQYDKGVISRDEYKNKVYKISR

SEQ ID NO: 7280 - protein, 370 aa, Acinetobacter baumannii
NFMYRTIETILVDIPTIRPHQLSVTTMRTQTLVLVKITTTDGIVGWGEATTIGGLNYGEESPESVKANIDTYFAPLLTSVKDLNVAQTLKLIRKNINGNRFAKCAIQTALLDIQAKRLGVPLSEVLGGRLRNSLPVLWTLASGDTEKDIAEARKMIELKRHNTFKLKIGARPLQQDVDHVIAIKKALGADVSVRVDVNRAWSELECIHGIQQLQDGGIDLIEQPCAIQNTEALARLTHRFDVAIMVDEALTGPDSAYRIAKNHGADVFAVKIEQSGGLIEACEVGKIAGLAGIDLYGGTMLEGPIGSIASAHVFATFETLAFGTELFGPLLLTEEILKEPLRYENFELHLPTAPGLGIEIDEDKIEKLRR

SEQ ID NO: 7281 - protein, 187 aa, Acinetobacter baumannii
NWSYFLSTIFLHNEIRKEIYMNKLNKLILGLGLTVASVAANAAGYGVIDLAKVVESSTYLKQQNASLNQSVKPTTTKLEQLGKELEGLQRQAQTQGQKMKEDEIKKLQSQYQSKLNEFNSTQQGLQSRVQTSLQSMNTTFETRVKQAAEQLRKENNLDFILNKNSTVAYDAKYDLTDKMIQKVNSMK

SEQ ID NO: 7282 - protein, 200 aa, Acinetobacter baumannii
KVEYWMPNQFETHTSDAGTTIHLKMNGELIENLIALDCIAITLFDIVFVYGVYEVYAENDSVLTLVLIFLVLPFIFYLHYEYRKNKRWAKNAEEIFFISKNNLHISKECLGEKLLTKDINTQKIIEIVYRPWGGRTNPPFLPDCGQGTIHLIGYEGGCSFGINLNKEEAEAFITELRSLIMQYQEPRHFIFAPHMHLAKD

SEQ ID NO: 7283 - protein, 165 aa, Acinetobacter baumannii
ILEYHEMLQDIGDQYPNGAINKEIIENFAATLEVTFPPEYVELISQHDGIYPVISSFDYVDTDGELNISTLELGGYLYEPRIEGMQFPEGDDDYEGKLISFGATPSGNFICFDYRFPWINDQPKIVLVLHDEFYNFGMNEGKRKVLYLADNFVHFINSLHEFIEY

SEQ ID NO: 7284 - protein, 252 aa, Acinetobacter baumannii
SDWYMRKYDNATTVENEGEILAGFQYRSLLSYQAYYHIKDIKYGSKNRSTLDFFPLEHVSKTVIFIHGGYWQWCDKSDFAFIAPYILAKGAQCVLLEYDLAPQSHISQIVAQTQQALDFIAKQNWKIGEVVVVGHSAGAHLGALCLNHPLLSKATLLSGIYDLLPIQETHLNHALNLSQEDILKYSPIHQQEQINIPCTILCGGLELSELKWQSQNYFEYRLSQGEDMISFEIIPEINHYSILEHYFKFIFK

SEQ ID NO: 7285 - protein, 170 aa, Acinetobacter baumannii
SQDLCYIAHQILIKRIMEIMDLSKAVQLAIVFSGVFLWIGMLTGVWKYWQIRRSELSRAHYYVDIAHRSSLLYAAATLILAVLSYFTILNEDIALWCVLANILFFSFSILVYIIHGFLQDTTNQFKQPHRLGHFSLPTWLMTFMMFALIITELLATVILVMGTILLFLSK

SEQ ID NO: 7286 - protein, 497 aa, Acinetobacter baumannii
EKNLILSSMHQGKYSISSDASYAQNLLYLENTMSKSAIVSRGLILSTLSIALVACVNMQAPQPAITSHIPQNFSQNHSGKTIAEKSYKEFISDPKLVQVIEIGLNNNRDLRTATLNIERVQQQYQITKNSQLPTMGVTGNAVRQVSPSINPNNPVSTFQVGLGMTAYELDFWGRVQNLKDAALNNYLATQSAKEAVQISLISNITQVWLNYAFAQANLNLAEQTLKAQVDAYNLNKKRFDVGIDSEVPLKQAQISVETARNDVATYETQILQAKNLLDLLAGHPVPQNLLPDHAIQNITFEKNFAAGLPSDLLNHRPDLKAAEYELRAAGANIGAAKARMFPTISLTGSTGYASTELKDLFKSGNFAWSIGPSIDLPIFDWGTRKTNIKIAETDQKIALAKYEKAIQSAFREVNDALATHAHIGERLDAQRRLVSATAATYKLSMARYRAGVDSYFTVLDAQRSAYAAQQGLLALKQMQLNNQIELYKVLGGGTSKV

SEQ ID NO: 7287 - protein, 466 aa, Acinetobacter baumannii
SPIHVRVIMEDIKNVTALEEQTIKRISSRIIPFLIILFIMAFLDRTNIGFAALHMNDAIGITQTIFGLGAGVFFLGYFIAEVPSNVLLHRFGARIWIARIMITWGIIAGLMGFIHSGTQFIILRFLLGIAEAGFFPGVIFYLTLWFPAKYCARVFATFYLGLPIAQIIGAPISVGLMQWGNTIGYEGWRLMYVLEGIPSIILGLVCLKYLTNNPKEAQWLTAEQRQWLMNTLEREEREKEQSADAALTKGELIKQVFKNPLVWIMAIVYFGITSGSNAMFFFLPSVLESFRNTFGMQISLIQNGLLTAIPYAFAAVGMVLWSRRSDRKQERYKHGACAALMAAFAIAIALIVNQPWAIIVGFILLAIGVFSAINIFWTIPGQTLTGVGAAAGIGLINSVGNLSGFTGPYLTGYLYTTTGTYTVAFLAIAGFVAMGGLGLLLLAKLKSDSLKVEQQRLKVRTATEMK

SEQ ID NO: 7288 - protein, 198 aa, Acinetobacter baumannii
VITQLFYLYMARPRSEDKRNAILSAAIKTLAELGERASTSKIAKVAGVAEGTLFTYFSNKEELLNQLYLSLKAELRQVMMLSYPTNADLQTQMSHIWQSYLDWSLEAPLKRKVMAQLSTSEQITEQSKQIGMQIFCDLTQNIQECINDGKLRDYPPLFIASILGALAEVTLNFIAQDPSQTERYRKSGFEAFWHAVSL

SEQ ID NO: 7289 - protein, 304 aa, Acinetobacter baumannii
WGTHNLTIRINLLLRMIMSKKFEYFDNPRQKALLGMKNSIPTEQWEENLKFLKQLRARIAELPVCKHPAIEVLNNGLLDKFTLTRIHLEYRHAIVQIFTDALLMAQFQTKQLEPKLHSGAKMFPRVLLSLNVLDEFGFRPGTDPDNYYLGNPEYAHYPLYEDLLNDYGLSEKDRREYQPSKIADQVRNFLESSYDSYIKVVALLAVAEEEVILFSPPLREATKAIGVDVEGGGYYHVHGVSTDETSEAADDDHEDDLWFALAQAITKEDYESLTTLCMDYCALWNEFWDAQIADIHYLEAKKLA

SEQ ID NO: 7290 - protein, 64 aa, Acinetobacter baumannii
NSYQNKIKKNILFKWLLVKKLIYVYCYMKLKDINLIYRIEGPSLKKMTIQLLKFKKFCFINLSS

SEQ ID NO: 7291 - protein, 188 aa, Acinetobacter baumannii
WNCQVIFLMCVQGNMQNFVYNRITLFLLSYCLAMLDHLEQFLPNKEPSSIQNFPFFWISQVNGKYSQLIEKSIKKLGIDNTRRKIILSTNALGEASITDIANLSTLKLTTATKAVYRLVEDGIVEVYSSTADERISMVKLTAKGVELVEQINQISVVTLAGILNAFSEDELHNLNHQLKKLFDLMPSS

SEQ ID NO: 7292 - protein, 366 aa, Acinetobacter baumannii
TSCHTTASIDSKFEVMHVISVGIVGGTGYTGVELLRILLRHPKAQVRVLTSRTEAGKPVADMFPNLRGHTDLQFSDLNIDALKECDVVFFATPHGVAMQHAKDLIAAGTKVIDLAADFRLQNLEQFEKWYGMEHACPDVLKDSVYGLTELNREKIKQAQVIGNPGCYPTTVQLGLAPLLKSAQALIETKNIIIDAKSGVSGAGRKASLGMIYSENADNFKAYGVAGHRHHPEIVEALENIAAKKDVFEGLLFVPHLVPMIRGMLSTIYVDLTEAGKQTDLQALYENFYANEKFVDVMPANSSPETRSVRGANELRIALYKPQPNKLIILAAQDNLVKGASGQAVQNMNLMFGFNEDEGLQGIGLLP

SEQ ID NO: 7293 - protein, 760 aa, Acinetobacter baumannii
KACHALCSINLNNKKNLIMITRRKFLNYSLNMGFGAAALAAFPSSIQKALAIPANNKTGTIQDVEHVIILMQENRSFDHYFGTLKGVRGFADRFTIPLPNGRRVWEQLRSNGQVLTPFHLDGTANNAQRADGTPHTWDDSQLAWDNGRMANWPTHKTDISMGYFKEKEIPYQFALANAFTICDAYHCSMHTGTDANRSFHLTGTNGATPTKRSFVNNEWDWIDGNPATADSGYTWKTYAERLEEAGISWICYQNMPDEWGDNMLGAFRSFRKANIASGYPVSSGGEPNKPYADTGQKLPYKAYDAATDNAKNPLYKGIANTLPGNKPEEYLDAFKRDIREGKLPQVSWINAPSIYCEHPDPSSPVQGAWFIQEIIDALTAVPEVWSKTALLINFDENDGYFDHMPSPSAPSRLKNGQYAGKSTLSNADMQDEYFDHAAPEGSHSQPTPDGRVYGPGPRVPLYVISPWSRGGWVNSQVFDHTSVLMFLEKRFGVKEPNISPYRRAVCGDLTSAFNFKTPNADVLPQLSGKQTRVQADALRENQEALPAVPVPTDIKLPIQQSGIRLSRALPYELHTSACCKADGKVQLIFSNTGKQAAVFHVYDKLNLDRIPKRYIVEPNKTLDDEWDALNNNLGRYDLWVLGPNGYHRHFKGDTQRIIDSGVKPEIRVCYDIANGDVYVELMNEGTKDTILTIKPCAYRQDAPLQLTIKAGQVVKQHWSLADVGHWYDFEVTSQSDSYYYRRFAGRVETGEDSFSDPAMI

SEQ ID NO: 7294 - protein, 192 aa, Acinetobacter baumannii
TCFHNGLEHEKLFLINIHLSKKMKEPDWINQNYKNKMHIIQVIIEYLKMLISKRRLIHAISYEGILLVIIAIALSFIFDMPMEVTGTLGVFMAVVSVFWNMIFNHYFEKVEHKFNWERTIPVRILHAIGFEGGLLIATVPMIAYMMQMTVIDAFILDIGLTLCILVYTFIFQWCYDYIEDKFFPNAKAASLH

SEQ ID NO: 7295 - protein, 359 aa, Acinetobacter baumannii
VSVQRKRPMNALNTLLTQSNTKETPVSLPVQLKAKYPLVQTFARQIAEHRQIIQNILAGKDQRLMVITGPCSIHDPVAVLEYADRLQKLQEKVKDQIFIVMRAYIEKPRTTVGWKGFMYDPNLDGSSNLQLGLEKSRELYLQIIEKGLPIASEILSPLATGYFDDLLAWGAIGARTSESQIHREISSHMPYSIGFKNGTDGSIQIALDAIQSAQNEHQFLGMNQQGLPSVIQSAGNPLPHLILRGANHGPNYDLASIQAIREKHKQNLPALVIDCSHGNSGKDPLRQPEVLQQIVAERLKTQVKGVMIESHLVDGNQKISCEMTYGQSVTDGCLGWDKTEQLLLNVAKQLKASELAHSA

SEQ ID NO: 7296 - protein, 420 aa, Acinetobacter baumannii
VQYQMITREQCLYWDQEDELKKFKDEFALPEGVIYLDGNSLGARPKKSLAVAQHIISQEWGEDLINSWNKADWWGLPTRLGDKVAKLVGAEQGEVVISDSTTLNLFKVLSAAVKIQADKFPEHKIIVAEKDAFPTDIYIIEGFIDLIQKGYQVELIDGVEDLSRALEKDVAVVVLSHVNYRTGYFYDMASINEQIHSKDALVIWDLCHSVGAVPMHLNQTDSDFAIGCTYKYLNGGPGSPALLWVNEKHRDQFWQPLSGWWSHKKPFDMAQHYEPANSIRRYLCGTQPVISMSLIECGVDIFLHADMQKIREKSLKLTDLFIQLVQQECSEFGFELITPLGHKHRGSHVSYRHEFGYEIIQALIARGVIGDYREPAVLRFGITPLYLGFEDIWNAVQHLKETMLNSEWKNKEYLVRGEVT

SEQ ID NO: 7297 - protein, 305 aa, Acinetobacter baumannii
GMNQYVSDALLTWTHHIKSVCGNFETDFDGTRNLFIGEVQCFLLGDTEIAFIKNNANKSVRKADEIDRVNNRFCFLILQYSGKMLLEYKNETLSLNEGDIVLVDPVETISMYPQGLVSQISVHLSREKLLKENISTEYFGKLITQNMSGFLLKNILKNMSAENIKLWYATEDGNAFEDALIALIKPTINYKNVHSSNNLMEKAERYIIENLAKPDLTPKLIAEHIGVSLRHLYRLFLQENLSINKYIQLKRLEKVKADLLDKKNKQSSITQIALKWGFWDGAHFSKIFKKTYGISPKEFREGMTV

SEQ ID NO: 7298 - protein, 130 aa, Acinetobacter baumannii
TYDHSEFSMSTLLLITSAPTSIHAWHALGLAQALKSKNEDFRVFFYQDGVQVANDFQWVPDDQRNLTHEWQKLAIRLPVCVSAALARGITDAENASRHQLSHHNLANNFELVGLGELADAVQSASRLLQF

SEQ ID NO: 7299 - protein, 60 aa, Acinetobacter baumannii
SSRQKYLNVPIAFSKARIISGDSFLYNLFILHLINIKLNYINIMINLKILKFIMRLIFKK

SEQ ID NO: 7300 - protein, 536 aa, Acinetobacter baumannii
GSLQEYRYYAWKSLMSKTTQENPAVENSAQEKVSNTSKSASNTAKRNSTTPKAATNTPKTTRTRSTTAPARSPRSKSAASATPSTSSNVAAAPKATKTKTSVQQDKTMSQNTVRRVAILGGNRIPFARSNTAYFKASNSDMLTAALNGLVERFNLQGKRIGEVVAGAVLKHSRDFNMTREVVLSTDLAPETPAYDIQIACGTGLQAAFVVANKIALGQIDVGIAGGVDTTSDAPIAVGDGLRKVLLELNVAKTGKDRLKALTKIDFKKLLDAPSNGEPRTGLSMGEHQAITALEWGITREAQDELAASSHQKLAAAYERGFFDDLMTPFLGLNRDNNLRPDSTVEKLAKLKPVFGKGETATMTAGNSTPLTDGASVVLLASEEWAKENGHEVLAYLSFSETAAVDFIGKNGPKEGLLMAPAYAVPRMLKRANLKLQDFDFYEIHEAFASQVLSTLKAWEDEKFCKERLGLDAPLGSIDRSKLNVNGSSLGAGHPFAATGGRILATAAKLINEKGSGRALISICTAGGEGVVAIVEK

SEQ ID NO: 7301 - protein, 410 aa, Acinetobacter baumannii
NLIQTEFVMTDITLAPVQPDQPTHLMATYGRQAISFVRGRGAYLYTQDGTEYLDALTGIAVCGLGHAHPAIAEAIAEQAATLVHTSNLFEIPWQTAAAQKLAEVSGMEEIFFSNSGAESNEGAIKIARKFGTQQGISLPKIIVAEQSFHGRTLATLSATGNKKVQDGFAPLVEGFIRVPFGDIEAIQEAALQHPDIVAILIEPIQGEGGINTAPQGFSYLEEVRQICNQHNWLMMLDEIQTGNGRTGKYFAYQHTNIIPDVLTTAKGLGNGFPVGAVMTQGKAVGLLGPGSHGSTYGGTVLGSRVVYTVIDTIQKENAVENAAVVGNYIVDQLRAQLSDKNVQVRGFGMMIGIQLPKDCAELVAIARDEYKLIINVTAGSVVRLLPPINMTQAQADILLERLVALITNYL

SEQ ID NO: 7302 - protein, 157 aa, Acinetobacter baumannii
ILSQDNKEQYMSYHHILVPVDGSPTSLIAVNHAASLAKAFSSKVTLVYALTIDPFISVEIIDSTEIAQDYFNKARASIQSILDQAKEQFSQHGISVETKIVEGQTIHTEIIKAATELKADLLVIGSHGRKGFKKFFLGSVTQALLGEIHVPVLVVTE

SEQ ID NO: 7303 - protein, 440 aa, Acinetobacter baumannii
GTPHQYFTIRNAEDWHISWKWIMELFHRFKPHTLAVATLILMCSSSWAANPNQQTEDEWKFTLKNAYINRDFDNDALKDTGSWSQAASLFYKSKMHDTPLVIADKPITIGADASVQYAVRLSSDKHVADTVLPFNKETQSQASDYLKYGATLKLGYDKTLLSVGELWLDLPVTAVDASRQLLTSYWGTNLKSQLSDQLYAEIGRVEKVSPRNEEDFKKFSFTANGITKESDGLNYIDLRYQFTPSLKGEYYFGNLEDLYNKHYVGLEHTWKQPTFALTSKFKYFNAKDDGNTFDIDAQNIGLLETVKVKNHTFGLGYQQIIGESAYPLPDGFLPETYFINWNATGFFKEDEKSYHVMYGYDFKDYIPGLNAMVKYVYGHDFKAANGEKNHETESNVILNYAFQQPLLKGFALQYIRIDYNVKHGNDFGEDRLFVNYTKKF

SEQ ID NO: 7304 - protein, 434 aa, Acinetobacter baumannii
FMQQLRTGDIIALGFMTFALFIGAGNIIFPPIVAQQAGDHVWLAAIGFLITAVGLPVITIMALSRMQGSIEIISSPLGRIASLILTVVCYLSVGPLFATPRTATVSYEIGFSSYFGTSSSSLLIYSAIYFAFVTVVSLYPNKLLDTVGHVLAPLKIIALAILGIAAVMIPAGYVPAPINHYVNSPVSEGFVNGYLTMDTLGALVFGIVIIQAIYSRGVTDNKLVTKYAIIASLISGVGLTLVYLSLFKLGLGSHEVAPNAANGAVILHAYVQHAFGNMGSLFLTGLIFLACMVTAIGLTCACAEYFAQLTKLPYKLLVFILVGFSFIISNLGLTKLIAVSVPVLSAIYPPAIVVIMLSFFWKFWHKPSFIVGSVTSIALIFGIIDGLKVAGFGDYLPNFLQHLPLNEQNLAWLIPSLVVLVVTTLIDKVKHKSI

SEQ ID NO: 7305 - protein, 71 aa, Acinetobacter baumannii
NKKQLKIKKIQSTVESSYKFYFNNKIETIDLKANFNLTINIHTFITNLEADFQQEYKDGICNHKRWRRHFL

SEQ ID NO: 7306 - protein, 228 aa, Acinetobacter baumannii
NFEQLKLEMCWAQSLWLCYAFFLPKKSAVFYISFIYNKNLIYNGKNMPNLTLPTRALKVVNTSIELFHRRGFHIVGVDRLVKESEITKATFYNYFHSKERLIEICLIVQKERLQEKVVAMFEYDHDTNAIDKLKKLYVLHTDVDGLYYLLFKAIFEIKNTYPNAYTTAIRYRTWLINEIYSQLRALKPDASFTDAKLFLYMIEGAIIQRLSSDEVDERMVEVFLRGMG

SEQ ID NO: 7307 - protein, 73 aa, Acinetobacter baumannii
PREQGIATFLMNELENFARGKSLRLLVLDTREGDVSELLYSKIGFVRVGVIPSFALSSNGSYDGTAIYYKKLV

SEQ ID NO: 7308 - protein, 61 aa, Acinetobacter baumannii
ESRHFLFPTYLIDHGPLFGNEYSLWNSFLIISIKNMTVRFIFATIKKDMDIKKPHYFVRFF

SEQ ID NO: 7309 - protein, 254 aa, Acinetobacter baumannii
TQLQRKNRIKEIKMSQHSWGAYAQRNTDDHPPAYTPGYKTSVLRSPKNALISINETLTEVTAPHFSSNLFGPKDNDLILNYAKDGLPIGERVIVHGYVRDQFGRPVKNALLEVWQANASGRYRHPNDKFIGAMDPNFGGCGRTLTDENGFYIFRTIKPGPYPWRNRINEWRPAHIHFSLIADGWAQRLISQFYFEGDTLIDTCPILKTIPSEDQRRALIALEDKNNFIEADSRCYRFDITLRGRRATYFENDLT

SEQ ID NO: 7310 - protein, 340 aa, Acinetobacter baumannii
GCLQMKRILLTGALFTAGFGVYGEANASCIIVNYQPNDVRIAVGRVVVRPSDPVGAVLRKATFPISSSGTQAMYCDSRDTVVAQLTQAYPLSSLGNSIYTTNIPGIGIRLYREAENSSNFSGYYPYERGGISGTRYLASGYFVVEIIKIAPQTGSGTLVPGRYSSYYVRGFPNQPFLTSTVDANAITIASSSCEIQGNINKVVQLPTVTKAGFKGVGSTQGDQTFDMNILCNGGINPTGYEEKNLISLTYDFTQDGTNNQVLANTAPTSEKANGIGVQLLWNYQNKNQVIKKGDKLALGTLSSNQTIQYNVPMTARYYQTATNVTAGKVRAMATVTIEYD

SEQ ID NO: 7311 - protein, 247 aa, Acinetobacter baumannii
CLTQMLDETAFKNFKLPRYEKVRWELQKLLIQSKWTVEEPIPSEQELAQMYSVSVGTVRKAVEGLVEDGLLVKQQGKGTFLKQPNFENSLIRFFRLRNKKGEFMQPQGQIKKVEVCDAIPEVNAELGLGHTDKLLYIERVRKHEDVVVLSERIWLPERLFKNLEEIPIAEFGNLLYPFYYQHCGQFVSSATERLTFEKNIKDSYLNNHLEDPLVKVCRIAKNLEGVAVEYRESYGLADNFHYEITIN

SEQ ID NO: 7312 - protein, 515 aa, Acinetobacter baumannii
MNKHVEAEWRFPAKTAWAIFAAMIFGNFMAILDIQIVASSLNEVQAGMSASRYEVTWVQTVYLIAEIIAIPMSSIVSRVLSTRVYYTMCAIGFTVSSLLCALSWNLESLLVFRGIQGFMGGGMIPTSMTALYLLFPEPKRSLPLVMFGMISTLGPAIGPTIGGWLTNNFSWHWMFLINIIPGIIIATVIYSGPNIDRANYSLIKSMDWFSLVGMAMFLGGLEYFLDEGARHDWLADTGVRVAFMVCVVGGMIFFSRSFTQPKPLLDLSVFKNKNFTLSAITTFVIGMALYGLGYMIPVFLGQVREMNSSQIGHVMMVTGIVMFCFAPFLAWLIPNFDTRKTVFVGMVLAGFGVWLNSHLSIHSDYDFMFWPQIYRGIGLMICLIVVSHLAMSTLPLSKVADASGIYNLMRNIGGAVGLALINSSLDWLTAMHVTQINQSMTPQNWIFTERLDQLTAQYQEVGANAQQIALSVIYRDIHFQALTSSFNDLLRMLAIIMFVTAFLTIFMDRGKKMNM

SEQ ID NO: 7313 - protein, 310 aa, Acinetobacter baumannii
IHEHNIMENIKFISKGITCSAWYIPATTDKYMNSRGRPCVVMANGFGGTKDTGLLNFAEPLSKAGFDTFIFDYRGFGESGGFPRQNVSYKNQREDYHAAIAAVRSLPNIDRNRIALWGTSYSGGHVLVAAAQDQKISAVISMNPATDGLAALSQICRYGGLKQLTVAVAHGLKDLAYSLLGQKAHLIPIVGQPGTAAIISTPGSEVSYKAMAGPTWRNEVCARTALEVARNRPINFAHQIKCPLLVQVGSNDQVTPPEAARKSASLANGEVKLLEYPIDHFDFYNEPWQIKILEDQINFLTQALARPRVR

SEQ ID NO: 7314 - protein, 175 aa, Acinetobacter baumannii
IIRQVGQFYIEESIKMKWDDIGDQPCSVARMLSVIGDRWTMLILRNAFMGIRRFDDFQKSLGVTRHVLSDRLKRLVEYEILVKAPYFDRQERFEYRLTDKGFELYPIILSMANWADKWMDQGLGKPLEYRHKACGHKFEPVMVCSVCREPLHAKQVQVSAGPGYFAYMEQKQKQA

SEQ ID NO: 7315 - protein, 465 aa, Acinetobacter baumannii
LLRQNMDCLFNKSFEKTMKGFQKLVLVTPLLITAQTSFADWIKDSVSKNESKTIQIRHYIHEHPELGNMEFNTSKLVQNELKSYGIEVRKGFAKTGVIGILKGDLPGPVMALRADMDALPIEEKTNLSYASKVKAQYQGELQPVMHACGHDAHTAMLLGAAKILAENKNRLAGTVVFVFQPSEEGAADLAGFSQGDQIGSRKMITDGALKKPEPEVMFGIHVVSGIPSGSIFYKDEAMLNSADEFRIKLTGQQVHASMPWAGRDPIVASAAIINNIQTMISRRSDLTKGMAVITVGHISGGTAANIIPKEVDMEGTIRTNNEDIRQNILQQLPEMVTHTALANNVKADIELSPYAPVTYNNKMLTQLILPTLENTVGKNNLHRMETNASASDDFAHYGKLMPSLYISLGATPKNQDMSKAAPNHSPEFIVDDATLKTGVESHIRFVMDYPAIASQVQKAWRNDKK

SEQ ID NO: 7316 - protein, 143 aa, Acinetobacter baumannii
NLFKGKIKMTLEITKQSLEKWHHMIQSNDLSNLNDLLADEVVFRSPVAYKPYEGRQVVFFILTNVIQVFQNFTYHREFYTEDGENVVLEFSANVGDKSLKGIDMIRFNEQGKIIDFEVMIRPMSGLAALAEQMSIRIAQFKPQ

SEQ ID NO: 7317 - protein, 349 aa, Acinetobacter baumannii
SPFKNQADYSEGNKERGGNYSLAKQNARSAATQNRIAYLRSFSMNRQQIDALVKQMNVDTAKGEVDARVQQIVVRLLGDLFQAIEDLDIQPSEVWKGLEYFTDAGQANELGLLAAGLGLEHYLDLRADEADAKAGITGGTPRTIEGPLYVAGAPESVGFARMDDGTETGKIDTLIIEGTVTDTDGNIIENAKVEVWHANSLGNYSFFDKSQSDFNLRRTIFTDADGKYVALTTMPVGYGCPPEGTTQALLNKLGRHGNRPSHVHYFVSAPGYRKLTTQFNIEGDEYLWDDFAFATRDGLVATAVDVTDPAEIQRRGLDHAFKHITFNIELVKEAAAAPSTEVERRRASA

SEQ ID NO: 7318 - protein, 94 aa, Acinetobacter baumannii
ISINSKFPNIISIGLKSDIVQYPYTFRKRTLRLTCTMKFIIIKTDTNSVIELIDLSFSIIMYFRFPFLYKIHVCNGDKGCHFFWSIYHIISTCL

SEQ ID NO: 7319 - protein, 87 aa, Acinetobacter baumannii
HASKSNTPKTRLSKPRMFMLSTPFEKLQTKNSKVSNSSGIIKIQISLMCQQLLLTHQHISSYLLFRMFFVHSYNDELRKKLIFKGII

SEQ ID NO: 7320 - protein, 498 aa, Acinetobacter baumannii
LQTKVLKTKALTLNTVKIMNKHLLLNIAFLGSVQLFTMSNALADVPLTPAQFAKAKTENFEKKVLLSNLNKPHALVWGPDNQIWLTELVTGKILRVNPETGAVKTVFQVPGIINDPHAQNGLLSFAFHPDFKNNPYIYISGTFKNPQATDKNSPNQTIIRRYTYNKSTDTLQKPVDLLAGLPSSKDHQAGRLVIGPDHKIYYTLGDQGHNQLTYLFEPNYAQSLPTQQELKNKDFHAYSGKVLRLNLDGSIPRDNPSFNGVTSHVYTLGHRNPQGLAFAPNGKLLQAEQGPNSDDEINLVVKGGNYGWPNVAGYKDDSGYAYANYSAATNKSQIKDLGQNGIKVAAGVPVTKESEWTGKNFIAPLKTLFTVQDTYNYNDPMCGDMTYICWPTVAPSSAYVYTGGKKAIPGWENTLLVPSLKRGVIFRIKMDQTYSTTYDDAIPMFKSNNRYRDVIANPEGNTLYVLTDPEGNVQKDDGSVTNQLENPGALIKFTYKAK

SEQ ID NO: 7321 - protein, 243 aa, Acinetobacter baumannii
PLYKYRVKTVHDVIEPSVLRTKSPFFIIAKNFFIFGLLWILSLFLYGVFYYDSYYSIFIYLISFYATYFFGYLISKPIVADLDSNTLNQVKLFSIIFSTLYYVIVPLRCFLVEIHDGLYGFRLGFGFVFPFWTLTPIFITNLKDKFYIYLCVLLCALEVIFGILFSKMSGSEFYKRPLSVAIFVSSFIFALTFPWYLSWLREIDINKWVLPFFFKEDRFISKLISWVAIGLGSCFMFLFYLFF

SEQ ID NO: 7322 - protein, 226 aa, Acinetobacter baumannii
LMNKSASAVSILFIGLTFFFLIFSIFSILYFYWGDIKVIQDSLSTTGSIFGAIDTLGAAAVAAYLFNDWKEQHNKQVQNSFALQVFDCFSVFENNILEYSMFISHLQDLRSSYENYELTWEILNKDGNTIYIQNIGSKKDELDLSFYRLMSKLKNYYIFNHDIYDFNKKHETYFNKFIEINKSLLPTNTLVEELIEYEAKLIGYKDLKNMIDILDISPIIQQLNAK

SEQ ID NO: 7323 - protein, 388 aa, Acinetobacter baumannii
IMNKTNPPLTDNTLITREATLADDEALRELIAVPMTTKGIQISFQREPSYFKASDIVYRHKLHVVIEDTESQKKVACYSNGYRPCYINRNIQNLRYAGDLRVDHNYRGKSLVKVLGKHVKQTMHEPNYSQMIIFDDNHAARAAIQTGKTGMPDYYDEGLIETLSLTSTGTKRKITAFLKQTSQQSHLQEIHTCTAEEEHVPAMNQFISNMGEHYNFIPAYNFEELAQGHQYFSGIKLSDFSLYFKGEKLVGMFGLWDQHSIKQTKILNYSSAIAVLRPVYNLLTPITKGMRLPKLGDSIQYHVLHTLICHPEDLALHHKMLEDAYNKSKQQGVGVVSFTLSHKDPRYQLNQFYKGERLTGMHGFISFEGDPRPSFDKKLIPYLEVGRI

SEQ ID NO: 7324 - protein, 389 aa, Acinetobacter baumannii
MMNKLSKMEFASQDKAVDLDALCQEIRERACAGEFDNQAYVSQDIIEKLKKIGVYRALVPKRFGGEEWSPRQFCELIETLSKADGSVGWVASFGMSPAYLGSLPEETLKELYQNGPDVVFAGGIFPPQPAEITDEGVVVRGRWKFSSGCMGADIVGVGISPLKNNEMQGLPRMAVMPANKAKIEMTWDTVGLKGTGSHDLVVEDVLVEKKWTFVRGEPSKLSEPFFKYPSLSLATQVLTVVGIGVAAAALEEFEKLAPGKASITGGSEIANRPVTQYEFAQADAEFQAAKSWFYQTMDIVWNEIIAGREATAEQISDMRLACTHAARVCAKVTRKMQMLAGMTAIYTNNPFSRFVNDTNVVTQHAFMGDATLQNAGLVSFGLKPTPGYL

SEQ ID NO: 7325 - protein, 252 aa, Acinetobacter baumannii
NKDKSMAKTILITGASSGLGAGMAHEFAAKGYNLAICARRLDRLETLKTELEHQYGIKVIAKSLDVTNYDQVFEVFRAFKQEFGYLDRIIVNAGVGNGRRIGKGNFEINRATAETNFISALAQCEAAIEIFRAQNAGHLVVMSSMSAMRGLPKHLSTYAASKAAVAHLAEGIRAELLDTPIKVSTIFPGYIRTEMNEGAKHLPFEVDAKTGCKALVKAIEKQPVKAYVPQWPWLPMSIAMKVLPLRLVNKLG

SEQ ID NO: 7326 - protein, 465 aa, Acinetobacter baumannii
SLSNLKGIGLKEANMASQDYATPSKSIDAQALINDAPLSKYQWMIAIICFLIIFTDGIDTAAMGFIAPALAQDWGVDRSQLGPVMSAALGGMIIGALVSGPTADRFGRKIVLAFSMLVFGGFTLASAYATNLDSLVVLRFLTGIGLGAAMPNATTLFSEYCPTRIRSLLVTCMFCGYNLGMATGGFISSWLIPTYGWHSLFLLGGWSPLILMILVILVLPESYRFLIVKGKNPEKVRKILNHIAPAQIQNATAFHVPEEKTEVVQKKNVFGIMFSKPYAKGTVLLWVTYFMGLVVVYLLTSWLPTLMRETGASMERAAFIGGLFQFGGVVSALFIGWAMDKFNPNRVIAIFYFAAGLFAIAVGQSLGNSTLLAVLVLCAGIAINGAQSSMPALSARFYPTQCRATGVSWMTGIGRFGAVFGAWIGAVLLGNDWSFTAILSLLLIPATAAAVAVFIKSIVAHTDAT

SEQ ID NO: 7327 - protein, 139 aa, Acinetobacter baumannii
MKSKYYLTLADAEFLMEEAQKYAIEHNFKVSIAIVDETSSLLLMKRLDGASPLTTHLCLEKAKCSSMSGRPSKFYEELLQNGRLGFLSMPSAKGMLEGGKAIIYEGQILGAIGVSGVQSFEDAEIAQHAIDVFLKKQSS

SEQ ID NO: 7328 - protein, 239 aa, Acinetobacter baumannii
NMSKADYKNPIPSKSQHALIVQQLGLKIVSGEISENAKLPSEVDLCEEYKVSRPVFREAIRVLNAKGLTYSRPKIGTVVRPKEEWHLLDPDVLFWLIQTTPEHEFFKTLSTVRRVLEPELAYIAASTANEEDIERIKQAYEGMEKATTVEEFIEPDIQFHLAIAKATHNDLLAYMSKMLVLPLQQSIQVTSLRPNLQGHSLPRHKAILTAIENKDPLSARHASLVQLDDTKMAYDLIKK

SEQ ID NO: 7329 - protein, 313 aa, Acinetobacter baumannii
NSGNCMKTDLNDLYYFVKVVQHGGFASASREIDIPKSKLSRRILLLEERLGVRLINRNTRQFDVTELGREYYHQCQNMILGAEAAQQVIERNQAEPCGVIRVSCPPAWLYDHIADMISKFMRLYPQVNIHLEVTNKNIDLLNDGIDIALRIRFPPLEDSDQVMKIFAKNPQCIVGHCELVQQHGMPETPLDLCGYPSIGLGNSEQKSIWTLYSRENGKIEKVIHTPRLIVNDMIGVRDAVLRGVGIAQLPFALIYKEIERGELINLMPNWELKNSIMHAVYPSRKGLLPSVRALLDFLSEEFETLINERPGFE

SEQ ID NO: 7330 - protein, 341 aa, Acinetobacter baumannii
EKGKYTMILVTGGLGFIGSHIALSLMAQGQEVVLVDNLANSTLQTLERLEYISGMYVPFVKLDVRNTPALNKVFEQYSIDAVIHTAGFKSIEESNLKPLEYYNDNVSCIMSLLRAMQRTGVRHFIHLSSLAVYGKSGSQLSETDDFNYAYPNPYIKSQQMIEEIIRDTYKIDHEWKIAILRLSNIVGAFEHGVLGEYVAQLPKNIVPLAMQVAAMQRDLIELQDQSSTEDHTVERSFLHVLDVCEAVSSTLHWLRDQSHCCEAFNIAHEQVHSIRQLLDEISQVTQAEIPTQSAIYKHEELAQIGANIGKAKTLLQWVPKRTLKQMIEDEWRFYQNTLNGR

SEQ ID NO: 7331 - protein, 157 aa, Acinetobacter baumannii
QILKRHVQFNDYPSDQPVKFLLNLKKIFPSTGDLLLPVLPEDNDLENVTWESTSKDFEIFKKLLAGWGVIELRLNAITAYKDKNFANELIKQAQAKRKKVAQKNHQLSLVALDYIFMHEIHALIDAELFTIGEKFYLPTLREQWKGTVSDQVLNGKL

SEQ ID NO: 7332 - protein, 518 aa, Acinetobacter baumannii
LNANQFLEKQCLAYIYLGSQTVSRNKIWVIDDDRAMRWVLEKTFKEEGFDVTNFEEAQTALERLHHDAPDVILTDIRMPGIDGLTFLSKVKNSHPDLPVIIMTAHSDLESAVSSYQTGAFEYLPKPFDIDEALALVNRAILHINKLQQQEATKTASPLQSTEIIGESPAMQEVFRAIGRLSQSHITVLINGESGTGKELVAHALHKHSPRRAKPFIALNMAAIPKDLIETELFGHEKGAFTGANTQHQGRFEQANGGTLFLDEIGDMPFETQTRLLRVLADGEFYRVGGHIPVKVDVRIVAATHQDLEKLVNEGRFREDLYHRLNVIRIHIPKLAHRSEDIPMLAQHFLARAGKELGVSPKILRTETTDYMQQLPWPGNVRQLENTCRWLTVMITGREVYPEDLPSELKQVPLQKSSETSQPAPSFERISLHHWDELLSQWAIQKLKNGEMKILDIATPMFERTLINAALQQTRGRKRHAAELLGWGRNTLTRKLKELGMDSADDDDEDEHKATLSEA

SEQ ID NO: 7333 - protein, 530 aa, Acinetobacter baumannii
NCCKHHTCISSKISRMNIMNRKASFQSLDADVLIIGAGIAGISAAYHLKKYRPNSTFIILEGRDDIGGTWSLFRYPGIRSDSDMQSFAFGFKPWTQKKTFGSAQMICDYLQETVKENGIDQYIQFGSYVTSAEFSSNEGIWTVKVKQKDQKSLVTLRSRFLLMGTGYYDYNNGYTPDFKGTEEFKGQIVHPQHWPENLDYSGKKVVVIGSGATAVTLIPAMAKDVEHITMLQRSPGYVVAMPSVDPIAVALNTVLSPQRAYEIIRRKNIAISRGIYKLCHRFPKVMRHLLIADVRRRLPKDFDVSTHFSPKYNPWDERLCVVPDGDMFKAISSGKASVVTDHIDRFIKEGILLKSGKVLEADIIITATGLNMLAFSKIQLTVDGKKINYPDTTIFKSMMLSDIPNFAFAFGYTNIAWTLKVDLVWQHFCRLLDYMDENKYGTFTPIIHNKTMKRVPFVDLSPGYVQRGLAQFPMAGTEGPWTLQHDYKVDFERLNKGPVCDKELEFTALVPKKKLAVVTEPSSEELMVKA

SEQ ID NO: 7334 - protein, 117 aa, Acinetobacter baumannii
LGCKLNAYMINQLYEQYSTMALSAWGFTDLPSYTDKYDPNEKDIVIKTNNWLNDEAAEEKTQQGLTAFVALDDAFMSIASRIYLIRNAKETIDLQYYIWTNDFVGNLILHELLKAAD

SEQ ID NO: 7335 - protein, 68 aa, Acinetobacter baumannii
IVSKKTPNLPTNKNYLMIGQKVYKSESNNLIMFIAVSLVLGLSLPVFGFSILFKLLIFAMRKYIPSKS

SEQ ID NO: 7336 - protein, 440 aa, Acinetobacter baumannii
SFLNAFSDFFGQSENGFAHPKFCDELERIVRKIDQKDNPMSKRIIIAGSGFAGLWAALAAQRAIHLASQEQNIEVLMVSPSPNVGIRPRLYEAVLENMNPDISELLSVVGVKFLAGWVNKIDVNQQTIEVATTDGNKQNLSYDRFVLATGSTTFMPPIPGLKEYGFSVNTLEDAEKLDHHLKNLATKPANAARNTVVVAGGGLTGLETVTEMPERLRSILGETDVRVVLVDSSTDIGAAMGDQAATVIREALNELGVEGKAGLRVTALDATGVTLSNGEKIETETVIWTAGMRANPLASQIAGEKDNLGRLIGDAYLHAPEAKNIFVTGDTVKVPTDDLGNFNVMSCQHAMSLGRVAGYNAAAELVDLPLHPYSQPKYVTCVDLGPWGALYTEGWDRQVQFVREEAKKIKQEINTVWIYPPVADRDAVFAIANPDFVIVP

SEQ ID NO: 7337 - protein, 505 aa, Acinetobacter baumannii
ILLNELREVKMSEVQILQSVQQFMARQHGHFIDGKLVAAELLDKVDIVNPSTEQVVAQISIGSQQDVESAVKSAEHAFQNAWAETTPYERGVKLNKLADLIEQYGEELAQLETLSTGKLINISRHLEVAQSVIFLRYFAGWATKINGQTMQPSIPSMQGEKYTAFTLRQPVGVVAGIVPWNFSLMIGVWKIGSALTTGCTIVLKPGEFASLSLLRLAELAIEAGIPAGVINVVTGKGDTGQYLIESPLVKKVSFTGSVPTGIAIGKLAMSSDLTRVSLELGGKNAIAVLADANIDEILPTLLQATFVHQGQVCASPERFFVHRTKYDELVDKLSKALSQFKIGSAMDEGSMFGPLSNQPHFHKVKHYLDMAKANNQIIAGGEALDQIGYFVQPTLISFKNTDDPLFSEETFGPVVGVMPFETDEELIQLMNQSRFGLTASIWTNDLSKALRLIPKIEAGTLWVNMHTFLDPSVPFGGVKASGIGREFSDAFIEDYTELKSVMIRY

SEQ ID NO: 7338 - protein, 79 aa, Acinetobacter baumannii
FLLNLTLCIDLMSSVWICKLFLRYSKVSVIKLNLSALEILQPKFMVMAIMSHFIKVALSTCPIKTVCNSMQAMETNWHI

SEQ ID NO: 7339 - protein, 86 aa, Acinetobacter baumannii
ILLKVGIKVGLYTIRYGYRNNSFFIASNTAGQFIVIDALGADFQIGHQISYEGSKIINETLNDETEAKVHLESNEKEAYEYLRTMK

SEQ ID NO: 7340 - protein, 61 aa, Acinetobacter baumannii
KRLKSLCLFWEKKRHSKAVKTVLGTSQVLLLLSFGRDDLKPEKPIGDQTFLKRFKLCRDSF

SEQ ID NO: 7341 - protein, 429 aa, Acinetobacter baumannii
FRLKEKDMKYKGIISLSLLMSITLQQAKAESEDNSALNEKIIKLQQQIDYLMERQNLNQNNGLNKAPELSPNKTSNTDKPVSADQTKIKFYGNIRVDAAYDFEGSTRSIANKTGSIPLDNSNSRSKSLNVSAATSRVGVDIVKPTSKGDLVGKLEADFMGSGGDNGNGSIRVRHAYISLGNWLIGQTTSPFVNSDTAPSLVDFTGAMGTGTQRNIQIRYQHIVDAKQKILVALEGGDVENKNVEGGSRFPALTMRYEFKNPDFLVQLHGMLHENRAISNANEEQTKLAWGVGLGTKYNLSENDSVVFNYYHIAGDNRYMLYSKDNDAFYFDQNRMYLSEFDSVELGYMRKWNENLRSSLSAGSLVYKNSDFSENNPEQNKRLINASVNLFWTPVEKVDLGVEYTYGKRETFSDLEGKLSRINLLGRYNF

SEQ ID NO: 7342 - protein, 145 aa, Acinetobacter baumannii
MSIKYVAMNISELSKLSGLSTPTIRYYEQIKLLPKAKRKSNGYREYTDNDLKQLSLIQQAQQVGFSLAEIKAFLPSKVAVWDHDALIQTLESKIQEIELLEQKLKVSKQNLRTMVEAINNKPDEITCEENAERLMNLYYDKSKTP

SEQ ID NO: 7343 - protein, 156 aa, Acinetobacter baumannii
QLVNKRNNIMNYRHIIVPVDGSEISLAAARQAAHIAKAFGSKLTAISLVAVDPFSGVDFYYISPVVKDYFVEARANAEKTLAKVKALCAEEGVDIETQIIQGEISSDGILKAVEELGSDLIVIGSHGRKGFQKLILGSFAQDVLNSTKIQVLVVKE

SEQ ID NO: 7344 - protein, 97 aa, Acinetobacter baumannii
ISSKAVAFRKSNHNYNKEFYMIQRISHHDLEHVYATAVNTIQSQMNFQDAVAQLEEVARAGHGKAALFLAELYYQGFRVERDSMKAQYWQKLATMQA

SEQ ID NO: 7345 - protein, 317 aa, Acinetobacter baumannii
SFSNGVESMNILGLESLVFGVLDLDACHQYLLDYGLNLVEKNERGGTYEALDGGTVIFKLDTDPSLPKANAPAPNIRETVYGVADQNELDLIAAELSKDREVSVDDEGTIHSFDDSGFAIAFRITRKRKIVAPHVGINVPGQEPGRAVNECGVLLEDHSKTPRSLSHVVYFVPDHKKAEAFYADRLGFITTDRFINIGPFMRPAGLNEHHSLFLIQSFNPHMVGVNHFTFHFGSGYEVLRNGWEFAQKGYKSFWGPGRHIMGSNFFWYFNSPFGGTMEFDADMDLHDDNWTPRAMPMGSDASQVFLFDQRKKWSPGE

SEQ ID NO: 7346 - protein, 68 aa, Acinetobacter baumannii
EMPKYLLLAEKISKNIKQDSSNNYLENLNNLIIEIKKAITGTELKFLYNFLDFSGSLLNLQDEGQSKT

SEQ ID NO: 7347 - protein, 1619 aa, Acinetobacter baumannii
VFTKMQNILTFIKNGQKFTLDASNIKSVRDTGNGFEITLKSGEIIQAESYSVTPNTQPVEQVSSQQVENNSEADEEFEKEEVLKEKSLLDSQTMLWGGAAIALGGIAIAASGSGGSAPSDQTPPASLTKILSKDGKAVSGLTEAGATVIVENSAGKVIGSAKAGADGTYLINLDKAYINGEILKVSAQDTAGNSTVKQELIASDITAPTLTHAISSNGKTITGLTEANSTVTVKDSSGKIIGTAKSDNDGKYTVILDKAYLNGENLTISAEDLVGNKSTIQTILADDKTAPIGLTVAIDTAGKVVKGVTEANAVVTVKNAAGIVVGTATADTAGKYSITLDKVYLNGESLSATASDQSGNATAPKTIIAPDTTAPSSLTASIGTAGKVVTGVTEANAVVTVKNAAGIVVGTATADATGKYSVTLNKAYLNGESLNVTAADKAGNATVPKTIVAPDTTAPSSLTATIDAAGKAITGVTEANATVTVKNVVGTIVGTGTADATGKYSVTLDKIYLNGESLSAIAADKAGNTTAATTIIASDTTAPSSLIATIDASGKVVTGVTEANAVVTVKNTAGTVVGTGTADATGKYSITLDKAYLNGESLNAIAADKVGNTTTPKTIIAPDTTAPSSLIATIDAAGKVVAGVTEADARVTVEQVTAVYKEVTVLETQFILSESVQTNYLSKTYSFEVTGTNAHVSLNLSSSTNSLSGSYSSILSGASLNTRLTGNVSQAGDGNYSIDLAQGSVLPPGTYTLTVNYSSSMVPVINVNVTQEVPKTILEVDHYETKVVGAANADEAGNYSITLDKAYLNGESLSVTAADQSDNKTEVKEVIAPDSTPPILHQPTIQGGWTEGQSVQGTTEANATIIVKNTAGDVIGSAIADASGYYNVILNTVYEDGELLKVIAADAKGNESSININTPDITAPILANLFNYDVSTDKIIFNAPSDSYIVEQKIGDAWVQVNVEEKFDWLNTEFRVTAKDLAGNSSQPLTIIINTASGTYKPTDPTFIQIIKGSIGNDYLYGGNGDDTLVSNTGSDYLYGGSGNDTLIYGGNSNVYTALQGQAGNDTYIVDKALLTSSSSIHILDNAAEENILQLKSVSSGDISLKQSDSLIIISFNDSASTIRFGEGQLSSIVFDDGTVWNKAQIEANTIGKLLGTDAADNLQADAEISTIYGLGGNDTIQGGVQNDYLYGDDGDDTLVSNTGSDYLYGGAGNDTLIYGGNSNVYTALQGQAGNDTYIIDKALLTSSSYIHILDNATEENTLQLKSVSSSDISLKQSDSLIIISFNDSASTIRFGKDNLSFIVFDDGTVWDKAQIEANTIGKLLGTDAADNLQADAEISTIYSLGGNDTIQGGVQNDYLYGGDGDDTLVSNTGSDYLYGGSGNDTLIYGGNSNVYTALQGQAGNDTYIVDKALLTSSSSIHILDNAAEENILQLKSVSSGDISLKQSDLLIIISFNDSASTIRFGEGQLSSIVFDDGTVWDKAQIEQHIAEPVFGTTVNDVIETNIPNQSYSYILGDGADTVVFNILDNTDNLGGNVKTEWTDFNLVENDKIDFSQLFINDSGDLQDYITVKDTEAGLIISVDRDGSSQSTYHSQELILLTGKHYTLEDLMASNAFIH

SEQ ID NO: 7348 - protein, 470 aa, Acinetobacter baumannii
EWTNDIALYVKACGCILIKKELEMSLKKVHRHSWVSLVICWIIWVVVAYDRELIFRAANMICNEFNLSPTQWGYTIAAITLSLAVLSIPVAALSDKHASGWKRGIFQWPLVIGFTFISLLSGITSLSSSFYKFVTLRIMVSLGCGVAEPVGVSNTAEWWPKEHRGFAIGAHHSGYPVGALLSGVAMATIITYFGPQNWRYAFFLGIIFAVPALTFWAIYSTRKRYSEFHQSCVDNQFTPPTDFVHDEGEEKTSTHSTWERLKQTLSSRGIVFTAASTLITHVVYIGFLTIFPAFLYNIVGLDLAKSAGLSAVFTITGMMGQIIWPTLSDKIGRRLTLILCGCWMAVSIASFCLTSGVVSVIAIQLFFGLSANAIWPIFYATASDYAPAGAIGTANSLITVAQYVGGAVAPIIMGYLLTSFGGWHSHQGYIWCFLLMSCCAFIGVILQIILGYLIKKEKLEQVDNLSLCAN

SEQ ID NO: 7349 - protein, 599 aa, Acinetobacter baumannii
KDQKMNDQNKRIFLRSQEWFDDPEHADMTALYVERYMNYGLTRAELQSGRPIIGIAQTGSDLTPCNRHHKELAERVKAGIRDAGGIPMEFPVHPIAEQTRRPTAALDRNLAYLGLVEILHGYPLDGVVLTTGCDKTTPACLMAAATTDIPAIVLSGGPMLDGHFKGELIGSGTVLWHARNLLATGEIDYEGFMEMTTSASPSVGHCNTMGTALSMNALAEALGMSLPTCASIPAPYRERGQMAYMTGKRICEMVLEDLRPSKIMTKQSFENAIAVASALGASSNCPPHLIAIARHMGIELSLEDWQRVGENIPLIVNCMPAGKYLGEGFHRAGGVPAVLHELQKAGVLHEDCASVSGKTIGEIAKNAKTSNADVIFPYEQPLKHGAGFIVLSGNFFDSAIMKMSVVGEAFKKTYLSDPNNENSFEARAIVFEGPEDYHARINDPALNIDEHCILVIRGAGTVGYPGSAEVVNMAPPAELIKKGIDSLPCLGDGRQSGTSASPSILNMSPEAAVGGGIALLKTNDRLRIDLNKRSVNVLISDEELEQRRREWKPTVSPSQTPWQEMYRNMVGQLSTGGCLEPATLYMRVVNQDNLPRHSH

SEQ ID NO: 7350 - protein, 72 aa, Acinetobacter baumannii
SCQKSWQQKLPMQFLRETSTQLQHAYSFMITQNFIIKFLGQRWRSPTFQVLSNQYVGLNLWRYVQEYAVQPC

SEQ ID NO: 7351 - protein, 353 aa, Acinetobacter baumannii
MFKNRFFNTMQIQNQVQLKPFNTLSLDVTASHYTKVKSIEDIEEALAFAKEHELNVLVLSGGSNMLLPQQINALVIHLDIQGIDVLSEDQDFIRVKVGAGQVWHDFVLYSTKQNWFGLQNLALIPGLVGASPVQNIGAYGVEVGEFIESVQVYDRLLKQTGSISAADCHFSYRHSIFKDDPARYIITHVTFKLLKQANLKLNYGDLKQAVGDNLTAENLQNQVIHIRQSKLPDPKEYPNVGSFFKNPIVNTQEFERLIAQFSTIPHYPQANGNVKIAAGWLIDQAGWKGKQLGVVGMFHKQALVLVNYANASLADVKKTYQAVQHDVEQRFQIMLEPEPVLYNNLGLIENHTE

SEQ ID NO: 7352 - protein, 460 aa, Acinetobacter baumannii
ITKNKAPQNRGASQKRQKGLEMPNVMKLSVLTIAVLGSQFALANEPWSQDRQWLLGDWNGKRQQLEQQGYKFTASIMSQSATNLDGGYNDSNTFENAAQLSLGANFDLEKIAGWKDTTASLVVTKRDGNALTLERIKDPRSSQLGNAQEIYGRGKIWRLSQAWVKKGFVDNTVQVKFGRMGMSEDFNSSQCEFQNLLLCGGQLGKSIGSIWYNSPVGVWATNVKYQFAPEWTLGVGVYEVNPDNIKTESNSDGFNLDMNNVKGATIPVELAWKPKLAAFNGLPGEYKVGALYSTAEANDIKTAGKVHDGKQSFWINAQQQLSHAGQDPKRGLYVSFNGVVNDKATTFVQSTQQLALWYKGPFDSRPNDSIGFGIANYVVNDRAKDKQIATNESRGYYSYDSIASDYIPIQDDELNVELNYTYQWSPAVMLRPNIQYIHQPAGVKEVDDAWVAGLSVKVNF

SEQ ID NO: 7353 - protein, 60 aa, Acinetobacter baumannii
VRKKAKQAFSQGDFDTSAFTFSNGVFCDTTTKLCHVNKFFENGHRSRVDKKMTDKIFKNR

SEQ ID NO: 7354 - protein, 308 aa, Acinetobacter baumannii
IMKNVGMKPESYRVAEAQAILYAPPHCIELLRQGNTEKGDALKTARVAGILAAKRTDELIPLCHPLPIYRADVEYELEHDFVKIIAVVETIGPTGVEMEALTAASLAGLTIYDMLKPHCEPEELWMDQCKLLKKKGGKSHFKRVLRQPVSAAVIVLSDTVAAGRKPDTAGKSVVETLTEAGFDPIHYQILPDEADDLKELVLELTKSYACIMTVGGTGIGKRDITVDTLEPLLERKLDGLMEAARSFGQKRTPYAAMSRGVAGFIDRSLVVTLPGSRGGASESMAAILPALVHIFDVCRDLPHPGGYE

SEQ ID NO: 7355 - protein, 72 aa, Acinetobacter baumannii
KMKNSNFFVVFIGSICFAFSANTLAQNTAAVFSPKRGVVCDKYICADKKGVSKSLTNQYLGAKKSKTSFFTR

SEQ ID NO: 7356 - protein, 323 aa, Acinetobacter baumannii
MMKKSLLGGLILSLCTTPAFALNILLVNDDGLTSNIKALYDELKANGHNVLVSVPCSPQSGRGGAIVMYSSTTITADNDKQIAAENGCHNGAAPIGAPAAGTFTKAGYTNGDWNYTHGTPVMATVYGLDVVAPKRWGKAPDLVLSGPNEGQNVGKVVVHSGTIGNVQFSAGRGIPSIALSADTNTVDDKTLSNPNSAIVAKQTVVLLKELQAKAGKDQLLPKGITLNVNFPKNLTTSTPFAFSKIGTYDLYKLKFQVTKDSKGNNQFGLGIDAAPSAPTAAQMSDESAVMQNKIAVTAMQVAYDQRPAGQEWLKIRLKSLFNK

SEQ ID NO: 7357 - protein, 397 aa, Acinetobacter baumannii
PIENTKVHVLFPPFTIQTRLGGFYFFYYSIVGTFMPYWNLYLQDQGFNYQEIGILSSIAIVTRFFAPLVWGWIADKSGKRMLLVRIATWMEACIWLAIFIIPNTFQSVALLMLIFSFFQNAILAQFEGVTLFWLGDQRAKLYGKIRKWGSVGFIVGVFTIGAILEIIPISMLPILLLIIASLAFIWAFTIREPEGAPTSQKHLEPLLPVLKRPEVAASFTIEFILLFSHAPFYSFYSNFLKSLNFSTTEIGFLWAMGVVSEIVMFAYATTFFKYFSWRSLVAVCLILTSIRWLLVAIFSHYFIGQLFAQCLHAFSFGLFHLIAMRLIFQNFSIGQQGRGQAFYSTMWGLGVAFGSILAGHYWKILTGEHIFMIAALVVLLGLCFVYWLPKRIEKSVS

SEQ ID NO: 7358 - protein, 961 aa, Acinetobacter baumannii
SQRNCSRIIMLALEPQHIHMNQHAVDKTHALKCLVDILEKDGLVTPEYITGLINREQQSATYLGQGIAIPHGTPQSREYILKTGIRLAHFPEGVIWDGENKIYLAVVIAAKSDEHLQVLQILTRALMHDVSEQVKNASKPEQIIELLQAQPLSLALHENLIQTEIDAQDIEDLFWAASQTLKKHNFVKCGFLSSLDPEQAIQLQDQIWSISSNHFVQQPAISITKPSQALELNGKKLNTLVCIAANDQLDNERFNRLIDILFNPEQVAELDKTQTPNEIAKIIGADVVPDWPQRSVVLANAHGLHARPATHLVNLTKTLQGDIQVAVDDSSFVSAKSLTRLLALGCKRGQTLRFIAEPETDAVEALDQVILAVQQGLGEEVEALPVTSEIPDQLPAQTAISNATTLGNNTGIAASSGLAFGPVHVIKPKVYQYERMGSGVKVEKENLDIALHAVKNNIHQVIAKADASEIKQIFRAHLEMLDDPDLINGVYQKIYQNLSAPAAWHEHIEAAAKAQEALPDRLLAERATDLRDIGDRVLTQLCGEVAIEEPKEPYILIMHDVGPSDVARLNKDRVAGILTAIGGASAHSAIVARALGIPAIVGAGEQVLEIDPKSTLLINGDTGTFVLDPDAAQIEQAKQEREQQRQIREEAERHSHEPAITLDQHQIEIAANLGKVQATAQAVECGAEAIGLLRTELVFMSHSSAPNEAVQEADYRVVLDALAGRPLVVRTLDVGGDKPLPYLPIAEEENPFLGLRGIRLTLRRPELLKQQLTALLKASDNRPLRIMFPMIGRVEEWRAAKAILDEVRAQHPCDNLQVGIMIEVPSAALLAPVLAQEVDFFSIGTNDLTQYTLAIDRGHPILSAEADGLHPSILNLIDQTVKAAHKHGKWVGICGELAADPKAVPILMGLGVDELSMSPNSIPLVKAQIRTLSYSHAQKLAQQALLCDSAPAVRQLSEQDL

SEQ ID NO: 7359 - protein, 330 aa, Acinetobacter baumannii
ELGKDPCMNVLITGGTGFIGKQIAKEILKTGSLTLDGKQAKPIDKIILFDAFAGDDLPQDPKIEVVIGDITDKTTVANITEKIDVVWHLAAVVSSAAEADFDLGMDVNLYGLLNLLEELRKKQTMPRVIFASGCAVFGGQLPEVVTDDTVVTPKSSYGMQKAVGELLVSDYSRKGFIDGRVLRLPTIVVRPGKPNKAASTFFSSIIREPLKGETAVCPVPPDTPVFITSPRRCVESMIKAASISSEALQDNRIIPLPGLTVTVKQMLEALEKVAGKQATDLVQWQEDKTIQRIVQSWPVQVKAEYAESLGFQADENFESIIQAHIEDTQN

SEQ ID NO: 7360 - protein, 375 aa, Acinetobacter baumannii
YKGNPKMKSRAAVAFAPGKPLEIVEVDVAPPKAGEVLIKITHTGVCHTDAFTLSGDDPEGVFPAILGHEGAGVVVEVGEGVTSVQPGDHVIPLYTAECKECLFCKSGKTNLCVAVRATQGKGVMPDGTTRFSYNGQPIYHYMGCSTFSEYTVVAEVSLAKINPEANHEQVCLLGCGVTTGIGAVHNTAKVQEGDSVAVFGLGGIGLAVVQGARQAKAGRIIVVDTNPDKFELAKQFGATDFLNPKDYDQPIQQVIVEMTGWGVDHSFECIGNVNVMRSALECAHRGWGQSVIIGVAGAGQEISTRPFQLVTGRKWLGTAFGGVKGRSQLPKMVEDAMKGDIQLEPFVTHTMPLQDINTAFDLMQEGKSIRTVIHF

SEQ ID NO: 7361 - protein, 418 aa, Acinetobacter baumannii
CKGKRMFELSKKAQDFTERTKKFIQEEIEPVEAKFWEEVHELNPDGNWKKWQWPELLETLKSKAKQAGLWNMFLPDEKLGAGLSVQEYAHIAELTGRSLLAPTVFNCNAPDTGNMEVLWRYGSEQQKQQWLEPLLDGKIRSVFCMTEPDVASSDATNMQATALIDGNEIVLNGKKWWSSGLGDPNAKVIIFMAHTPDETKDRHHQHSMVLVPIDTAGVEIQRMLPVFGDYDAPHGHGEVHFNNVRVPIENFIGGAGQGFEIAQGRLGPGRIHHCMRCIGAAEKALELMIDRGMSRTAFGKEILKLGGNLERVADARVAIDQARLLTLYAAYKMDTLGNMAALTEISAIKVVAPSVLEKVVDMAIQLHGGAGVSRDTPLTGFFAQARSLRLADGPDEVHKGMIAKLELAKRGYGRHKKV

SEQ ID NO: 7362 - protein, 230 aa, Acinetobacter baumannii
CKGKVMAIGFRVLKNDRKVEQKWIEQYRDLPVANVSDSMNRMTSGGAQLRPMHKKGYLCGPAITVKARPGDNLMLHYAIDIAEAGDVIVVDAGGDLTNALIGEMMVAYAIKKGIAGIVINGAIRDSVVIGEGEFPLFAAGISHRGPYKDGPGEINVPIAINGMVIEPGDLILGDEDGLLSVPYLEVEEVYLKASAKHAAEQKQLEQIAVGENDRSWVINSLKQKGCELPE

SEQ ID NO: 7363 - protein, 226 aa, Acinetobacter baumannii
KVMNKLLTILLLSALVAACNNPNSTTKITQVQSEQSNNQKEALKPLVAEFNEIMNSLQTEADITSTQTKLEKLLKKFPNDNDSSIQVQKLKLKVLLQLGYLNEANILATKILALDSTAGIQETQCLIQRKLQKPENQINSCYEKAAKLYQAQYEKLSNDNPQKQYALWSSYAALYQAGHTEYKQKLKAIVNAQTTEDEKHTFNTMYENVVDPAVIKEILESMPYKK

SEQ ID NO: 7364 - protein, 105 aa, Acinetobacter baumannii
EVMNKYLMLTLLATSSLSLTGCAQMFPAQATKLENGNYMIQTTSNILGSNEAMENKVNKKAETVCAGKGFSEINNNHQTHSQQIYTAQVITTGTFKTFNKTIKCN

SEQ ID NO: 7365 - protein, 308 aa, Acinetobacter baumannii
CIMNNIHNLHGLDLSFFHRIDINLYPLFIAIYEQKSISNAASSLNITQSAASHALQRLRQQLEDDVFIRVGNKMSATPFAEQIYPTVKQALLTIQNISQQKHVFDPTSLKNLKIAVHDEIEPIILPRLAQHFQNLNLDLQFVSMKLDRKHIMADLATQQLDFVIDLEQYLSPKITFDHLVTDEFVICSQLKEVDLARYISGRHIGVSSRRTGALLEDIYLNQHQKISRNVFMRCQNYSTALQVLGAQVDAILTMPRMILQHLSYSPEIRLHSLPFEMTNIKMGMFWHEDLRDNLRHQFLRHEIIKLFQ

SEQ ID NO: 7366 - protein, 76 aa, Acinetobacter baumannii
LIMKLICIEVYFMSLKNLDINSRLIREIAIILIIKVALLLTIKHIWFDAPTIPKNFDNQVAEHIAGDNSSHIKETR

SEQ ID NO: 7367 - protein, 300 aa, Acinetobacter baumannii
TPMNIKQQFTEVEFGQQKIKVPKGGYYDRFRMNPDLDKVAQDPAAGNIDFFRHIPKKIVESRVGPVWAPNFYYRSANVQLLMLAPIKQIKAKLPADLTPLQPFPGYGLVAVTFFSYSVCDNDPYNEVSIAVVVRQPHARGPHIAELMKSMRQRHFYAHVLALPVHTEIARVRGVYGYQLPKWLTKIDIGISSKEVQAKIFDVNGKLDLSLKTLVPTLKHVDSETHINKATMLHVVDGKWHQTEVQSNILSFAQKLFPKKVRLVKNEGPLTKLLNELGASKILRLDIIEDAQVVLNLPTPL

SEQ ID NO: 7368 - protein, 274 aa, Acinetobacter baumannii
CEMKMNCIDTHAHVFSTQDLSIETARYAPDYEATVQSFISHLDEHNFTHGVLVQPSFLGTNNQAMLNAIQQYPDRLKGIAVVQHTTTFDELVNLKAQGIVGVRLNLFGLNPPALNTPDWQKFLRNVESLNWQVELHAPPKYLVQLLPQLNEYSFDVVIDHFGRVDPVKGIEDPDYQKFLNLLNVKQHWIKVSGFYRLGTTPNNINTAQQAYNIFKEKGFLHKLIWGSDWPHTQHESLITYEDAIKAFKQIVFDKHEQCLILNQNPTELFGFSRT

SEQ ID NO: 7369 - protein, 182 aa, Acinetobacter baumannii
GFKKGLYKQKLALMKSLIIHLSKISSAFYYHFGLYNKILNILCNFKQQGGLQSDVNTPYNAARLVEDLFMTEQARDTEALIRDQIAKHPVLLYMKGTPQFPQCGFSARAVEALSQIGRPFAYVNILENPDIRATLPKIANWPTFPQLWVNGELIGGSDIMLEMFQNGELKPLIEQYSAAPEA

SEQ ID NO: 7370 - protein, 230 aa, Acinetobacter baumannii
TSEKKMDLSNILIGDTTWSFVLEILVRCTIMFIIIISFLRLSGKRGIRQLSLFELAIILCLGSAAGDPMFTKDLPIAHALIAFIAILSLYRLVTWGMVKHKKIEDLLEGKALCVVKEGLLVYKDFQKQTYSHDEFFSEMRQQNVEHLGQVRTALLESDGILSLLYYEDEDVKWGLPLFPDAYRKAEVLKINTFYSCMKCGETKILNKLDQECSRCHHHSWAESLKTRRLG

SEQ ID NO: 7371 - protein, 166 aa, Acinetobacter baumannii
QTGNLGYCFMDEQAENLTPLELKIMRCLQENGRLSNAELAKLVGISTSSCWNHTQRLFKIGAILDVRARINPGMVQRETIVLVGVVLDRSTPDSFQAFEQAAGDLENVLECYLVAGEVDYFLKIRVKDLAAFNRFHSEKIIALPGVRQVRTFFVLNEVKTDGMLAF

SEQ ID NO: 7372 - protein, 272 aa, Acinetobacter baumannii
CGFERSTRRVKVKQTISNRQGKQLAVYTDGLKDAPVLMFSNSLGTDHGMWQPQLNELKSHFNVITYDTRGHGESDVISDTTLQNLAEDVVDILDALNIEKAHFCGISMGGITGLWLGIHHPNRFNSITVANSAAKIGQTEAWLSRAESVEKNGLAELVKTTHTRWFSEKFDYQHNVVAQTTIQSLANTPAQGYANACRALAYADLRDEIAQIQIPALLIAGTEDPVTTVADAEFMQKAINNSQLAKLEASHLSNIEQPQRFTQELTRFIQQI

SEQ ID NO: 7373 - protein, 487 aa, Acinetobacter baumannii
GYDEMNTLRLTTLALGLMVSGIAAAQTYVVDRYQDDSNKGSLRWAIEQANANPSEASEILIQAVGKAPYAIKLNSALPEIKAPVKIIGTEWDKTGEYIAIDGSNYIKGEGAKACPGANPEQYGTNVRTMTLPGLVLRDVNNVTLKGLDIHRFCIGVLINRSSNNLIQHNRISNNYGGAGVMLTGDDGKGNPTATTTNNNKVLDNIFQDNGDGLELTRGAAFNLIANNHFVSTKANPEPSQGIEILWGNDNAVVGNKFENYSDGLQINWGKRNYIAYNEMTNNSIGFNMTGDGNILDSNKVHGNRIGVAIRSEKDANARITLTKNLIWDNGKDIKRCEAGGSCVPDQRLGAIVFGVPALEHEGFVGSRGGGVVIEPSKLQKTCTQPNQQDCNAQPNQGIKAPKLTANKGSVTVEVNGLPNQRYQVEFFGNQNAASKEAEQYLGTITVATDAQGGAKANWKPSVKVASITANMTDRFGATSELGFVQVK

SEQ ID NO: 7374 - protein, 857 aa, Acinetobacter baumannii
KQRDLRRNTMKLVMIGHGMVGHKFIEAILEKADDELEITILAEEPRIAYDRVHLTEYFSGKSAKDLSLARFDFADAYGIDLRLNTKAVAIDTTAQTVTTNHGDVISYDKLVLATGSYAFVPPIPGNDRENCFVYRTIEDLDAIRAASLKAKTGVVIGGGLLGLEAAKALRDLDLETHVVEFAPRLMAVQIDDLGGKVLRRKIEDLGVKVHTQKATQSIESGVNTTHVMKFADGSELETDVILFSAGIRPRDELARNSGLAIGERGGIVINDYCQTSDQNIYAIGECALWQNKIYGLVAPGYDMARIAAKHILDEECHCFAGADMSTKLKLMGVDVASVGDAHAMTPGALSYFYADEHALVYKKIVVNADKTKLLGAVLVGDAKEYNDLLQMMLNGLALPEVPESLIMPGFEQSAAKSGGSGVDLLPDSATICSCNNVSKADICQAISDGSTSLGALKKCTKAATACGGCAPLVTQVLKSELQRQGVTVNNHICEHFPYSRQELYHLVRVNEIKTFDDLIHQHGHGLGCDICKPAAANILASCWNDFVLKPSHAGLQDSNDYYLGNIQKDGSYSIVPRMAGGEVTPDGLIAIGQIAKKYNLYTKITGGQRVDMFGAQVHELPFIWEELNAAGFESGHAYGKSLRTVKSCVGSTWCRYGVDNSVGLAIELENRYKGLRSPHKLKMAVSGCTRECAEAQGKDVGVIATEKGWNLYVCGNGGMKPRHAELLASDLDKETLIRYIDRFFMFYIQTADRLQRTSVWRDNMEGGLDYLKSVIVDDSLGLAAELERRMEHIIGTYQDEWRTAVENPEVRKRFQTYINAGANEQADPHIQFTTERGQIRPLTEAERSEDRIPMVEA

SEQ ID NO: 7375 - protein, 76 aa, Acinetobacter baumannii
DMADLTAKKVSKLIEEFRQTGKEPEKLVIGYKTYARLMADDKFAEKVVPSLENSKDRLYKNLKIKLITEKHYFEVK

SEQ ID NO: 7376 - protein, 89 aa, Acinetobacter baumannii
QCHEASARLIQTELIKSSNKNDPQYRDAEFVYLTEMYKAGHNDYKAKIQKFIDETKDVASKDKYKSLYDADIESFYGTDSPNYVPESLK

SEQ ID NO: 7377 - protein, 375 aa, Acinetobacter baumannii
DRNDSLMDQHTPIDYRLLVDNLTTAILLIDSNFNIFYLNSACEALFDISLLRASGQPVLNLLHAPDDTFNTHEALLNTLKTGQPYTRREAIINVNFKDLHVDYTVSQLNAGKSYHPLLLIELNPIDRMLKISKEENLIQQHQVARQLVRGVAHEIKNPLAGIRGATQLLARSLNDESYAEFTDIIINEVDRLTNLADTMLGSRQLPSYENVNVHEPLERVRSLIANQTKKKIKITRDYDLSLPDVKADRDQLIQVMLNISVNAIQAITENKSFFTDQEPELILRTRIQRLVTINGVLNRSAVRVDIEDNGPGIPESILESVFYPLVTGRAKGTGLGLSIAQNIMHQHNGMIECQSVPGKTMFSLYLPWESDRVAK

SEQ ID NO: 7378 - protein, 333 aa, Acinetobacter baumannii
CSRDLYGCKRRFRRKMMNVLQQIDEFTVDPLQFRRALGNFATGVTIVTAQNAQGEKVGVTANSFNSVSLDPPLILWSIDKKSSSFSVFEEATHFAVNILSGTQIELSNKFSRRNIDKFADTNFQLGAGRAPILENCSAVFECERYQVIEGGDHWIIVGKVVRFHDQGRSPLVYHQGAYSCVMPHPSLQVKQTEENGVDQTHYGHLYNNVCYLMSRAFKAYQTDYIPKQMASGFRTSESRLLLVLASGTASSKEDLPRDIAMPMQEVERSAEILKFEGLLVDHDNLYALTEKGKQTAQYLFDIADSHQNEVFKKYSDEQKDIFITMLRDFAGVA

SEQ ID NO: 7379 - protein, 259 aa, Acinetobacter baumannii
SNRDSKSIQFKRSWSKIMAETISPRYSRILLKLSGEALSGNKDMGIDAQVLDQMSLSIAHLVGLGVQVGIVVGGGNLYRGSQLQKDGLVGRVTGDQMGMLATVMNGLAMRDALVRRNIRTRLMSALPIGTVVESYSSRDAIRHLSQGEVCVFVAGTGNPFFTTDTAACLRGIEIEANLILKATKVDGVYNKDPSKYEDAVKYDHLTFDQVLDEKLGVMDLTAICLCRDHNVPLQVFDMNKSGALLSVVMGEKEGTRVTK

SEQ ID NO: 7380 - protein, 215 aa, Acinetobacter baumannii
RKRFMNVSPIIVLDFETTGASPEAGDRITEVAALRIVEGEITERFVSLINCGVNVPYYITKLTGITQDMVNHAPLVEEVIPSLLDFIGTDPLLAHNAGFDEKFLKAESIRQELTPSHNGLICSLKLARRILPHQLSYRLGAMADLFNIKFNGTAHRAEADAEVTAQLFNYLCMNICHTYGFNSIDQDLLLAINKLTISRVPKYLKNIAAQSLLLK

SEQ ID NO: 7381 - protein, 205 aa, Acinetobacter baumannii
SLLETTRIYNGKTMQNLKTSSKKLQVIHTAIRLFVTYGFHTTGVDLIIKEAKITKATFYNYFHSKERLIEMCIAFQKSLLKEEVLAIIYSNRYRTSKDKIKEIINLHVNFNSLYYLLLKAFFEIKHMYASAYRMAVEYRRWLLHEIFDLIFSLETHVLKPDANLVLNLIDGLMFQILSSKSLEERDVVVERFFGVVNTAPNYLKI

SEQ ID NO: 7382 - protein, 275 aa, Acinetobacter baumannii
LSLDEPLHVYRLIIFIERLNVTIQTEQEFLASYDRRDYDAPLLTVDMAIFSVFNGQLQVLLIKRPNFPAKDQWALPGGFADLTHDQDLMATAYRKLVEKTGIASPYLEQVASVGNAKRDPRGWAVTILYFALIDFNAYQHQALAEYSEWVPVAKAKDLALAFDHNELLNLALERLTNKTRYTALPASLMPELFTLTELQTIYEIILGQSLDKKAFRRRMIEAGAVEETNHSKIVGKRPAQLYRYALDSFDFIFPRSLELPRNKEGEDKQNNELSD

SEQ ID NO: 7383 - protein, 447 aa, Acinetobacter baumannii
SNIENLATESASTHHTLNYRYFSTLTPHFSDYPYTLIKNNTNIKKSLGLDSMQKHLLLPLFLSIGLILQGCDSKEVAQAEPPPAKVSVLSIQPQSVNFSENLPARVHAFRTAEIRPQVGGIIEKVLFKQGSEVRAGQALYKINSETFEADVNSNRASLNKAEAEVARLKVQLERYEQLLPSNAISKQEVSNAQAQYRQALADVAQMKALLARQNLNLQYATVRAPISGRIGQSFVTEGALVGQGDTNTMATIQQIDKVYVDVKQSVSEYERLQAALQSGELSANSDKTVRITNSHGQPYNVTAKMLFEDINVDPETGDVTFRIEVNNTERKLLPGMYVRVNIDRASIPQALLVPAQAIQRNISGEPQVYVINAQGTAEIRPIEIGQQYEQFYIANKGLKVGDKVVVEGIERIKPNQKLALAVWKAPAVVNHASSVETKTSITEGAQP

SEQ ID NO: 7384 - protein, 163 aa, Acinetobacter baumannii
VMKEFARIQEQALSLDTFDPIQSFPECGGIDIFMGTVRNHHEGKAVKALKYTSYKPLAEKMIREIELEIEKKYQVSYVRVVHRIGYLDVGETAIIAIAYAAHRREAFQACEEAVERVKHEVPVFKEEFFTDGTSHYVEGCCIRKDAPHDHKHHHHHAGHEHSH

SEQ ID NO: 7385 - protein, 68 aa, Acinetobacter baumannii
SKRDHDQALFYVKKLFFRPYQSSRDIKNINWLSYLLENSLKEIKKTFFRSDFLKKLCKNENINFYYEC

SEQ ID NO: 7386 - protein, 273 aa, Acinetobacter baumannii
RFLDSDPCTTYQSFKTYRPAKIARIGICSAISTENTGYFKKMTTIYLVRHGQASFGKSNYDELSENGEAQATLLGRYFKQILKEQPYVVAGTMQRHEQTAQLALKECFPDAVIHHNNLWNEFNHQQVFARYEPRFEQPELLKADVAQEQNPRAYLAKIFEGAIERWTDGDFHHEYDESWPHFKNRVETALQQLCDELAKTKPRYAVVFTSGGVISVAIGKLLELSPNRTFALNWAITNTSLTTLRLVGNEAQVLSLNEHHFIKAERPDLLTWI

SEQ ID NO: 7387 - protein, 141 aa, Acinetobacter baumannii
SPMDIRKIKKLIDLMIESDLQAIEVKEGDQSIALTRRNPVVAAAGVALPAAPVAEAPVAKTPRGAVETSPMVGVFYAAPSPGEAPFVKVGQTVSAGETLGIIEAMKIMNPIEATQSGVIEEILVKNGEVIQFGQPLFRYRA

SEQ ID NO: 7388 - protein, 167 aa, Acinetobacter baumannii
QLKERAMNMNLQLLNEVTAFIWAEADMLDHSEYREWLNLWNEKGVYIIPIDPNLTDYENNLNYAYDDNHMRKLRVERLENGEAISTAPKANTVRSISRVRVIQDQDDEIVLRCAQNLREFRKENLKHYTADITYHLTRDADTGFKINRKIINLVNSTDTLAGISYIL

SEQ ID NO: 7389 - protein, 190 aa, Acinetobacter baumannii
ISKEDHMINDLKKDSEQRMLKTLESLEQGFAKVRTGRAHPSILNGVMVPYYGSDVPLNQVANVGVEDSRTLIVQPFERTMVAAIDKAIRESDLGLNPITADSIRVPLPALTEETRRDMQKIARSEAENAKVAIRNIRRDVLGDIKALLKEKEISEDDERRAGDDIQKITDKYVAEVDKRLAAKEAELMKV

SEQ ID NO: 7390 - protein, 290 aa, Acinetobacter baumannii
LFKDTCSLFKDEPMNMKTLLSLSLLALPFFTAQVNAEPVALAAQAQPAATAVKTIVPITAKTKEQALAQAQVIANTADADLAEFRIDLLSFASDTKQVIALGHELKKILGNKPMIATIRTKNEGGQLEISDADYGKTYQAYLKNPFMDWLDVEMFRDQKVVSEIVQQAHQKKVLVVMSNHDFQKTPSQDEIEKRLLKQDQMGADVLKIAVMPKSKQDVFTLMNATLKVSQQTTKPLLTMSMGQLGTISRVATANMGGSYSFGMIGQASAPGQIDVTKLKQILQTVQPTNP

SEQ ID NO: 7391 - protein, 119 aa, Acinetobacter baumannii
KMEDFVMKFWQRLFTSFLQRFHLMRFFGRNRSFKELHQSSYAQEISKNLSKRLLNASRAQTNDLLKQFDTHLTGLTEEQAYTQQMTVGLNEVTHEKPLTWWQHLWYCYRNSIFYLACWH

SEQ ID NO: 7392 - protein, 431 aa, Acinetobacter baumannii
GFREITIKKDIDMNEITTKKANPILLGVLGVFVSNISHASALEQSGQSILPFLENGNYAEANLFAVDSSVSGVVNDRADLVRDHQSRDTGDIAESTQFYTAAIKLQLTDRLGFGVLYDQPFSADIKYPARSNNSYFDNDISYEGTSVKANTQNLSLLFGYSPYQHFQIYGGPVYQTVKANVALRGNAYTQAFNGYNAKFKQQGEVGWLLGGSYQLPDIALKAAITYRSKIKYQFQVEEDIFGEPLKLVENEKTKLETPASLNIDFQTGISEKSLVYTNLRWVNWKEFETRPPQYGALSEILMKELTNGEYIQGFKLDSYQNDQYSATLGIAHQFTEKWSTSTDVSWDSGTGNPASTMGPIKGSWSLGLGVQFNPAKNYFITGSLKYFWLGDTKTEDGTYYLPIEGIKPYAEQENFKNNQAIAYGLKFGYWF

SEQ ID NO: 7393 - protein, 407 aa, Acinetobacter baumannii
GSREMTLKNAYIIDAIRTPFGRYAGGLAPVRADDLGAVPIKALMQRNPSVDWEQVDDVIYGCANQAGEDNRNVGRMSALLAGLPYQVPATTINRLCGSSLDAIAIAARAIKAGEANLVIAGGVESMSRAPYVMGKSDSAFGRSQKIEDTTMGWRFINPKLKELYGVDTMPQTAENVAEQFNVNRADQDQFALVSQQRTASAQAKGFFSKEIVAVEIPQRKGDAVVIDTDEHPRASTTLEGLSKLKPVVKADGTVTAGNASGINDGAAALLIASDDAVQAYNLKPRAKIIASTAVGIEPRIMGFAPAPAIKKLLKQANLTLEQMDVIELNEAFAAQALAVTRDLGLPDNSDKVNPNGGAIALGHPLGASGARLVTTALNQLEQTGGRYALCSMCIGVGQGIALIIERV

SEQ ID NO: 7394 - protein, 399 aa, Acinetobacter baumannii
FFRDLEHLAMQKILQDFSIPAVFAGFITFLIGISVSAILVIQAAQALGASSEQITSWFWALGLGIGLSGLILSWKFKYPVATAWSTAGLALIMATGSGYSLNEAIGAFLVGGLLTAILGFSGIFQKALSYIPQSLTSAMLAGVLLKFGISLFASLQNDWTFVLSLLAIYVITKRLWPRYSIVFTALAGIGLCPVFLDFHMPTLEWSLAKPVWISPEFSWSALLGLALPLFVISMASQYLPGIAMIKSYGYKPHVNQLIGWTGLTQVVLVPFGCYSVNIAAISAAVSLDDQVHPDPSKRYIAGISCGFFYVLMGLFAATLTSLLMSFPHIFIVALAGIALLGTISHNIALAFGPVEDREAALFTFLCSASGIQFFGVGSAFWGLVVGIVVFIVLKFKPKK

SEQ ID NO: 7395 - protein, 62 aa, Acinetobacter baumannii
TFGLITWTGPKAKPLDAAIPVLLPNVVAFDIAVWAGSWSGISLVTGSASTSSPKPCCTAKIT

SEQ ID NO: 7396 - protein, 543 aa, Acinetobacter baumannii
SLTLLFCTSCIYEVLMTQQQACVISQLTLELPSKVVFKELNFSLEHHQVSALIGRNGQGKSLLMQLLHKISPITEMYISGQINWQTNHAYLSQLTRLQSDTIAEALEVNHLYNAFQRVEQGEAEYDDYDLLEGHWDLPNIWEALLRSAQLPTDLDFPVKQLSEGQKTKLALSALFLKTDHYLLLDEPSNHLDQEARQWLIAQLKKHPVGALIISHDLTLLNEVDHIYHLNEHGLQHTTGNYEKFYAQYQSQIEALEQSVHQHQREVKHMKQKQHEVLMKAQKRERAGNKLRDSNSQAKILLDFKKEQAGQSLGAIHSQHQRQIDQSQQDLKSKKVLLETVKPQQFIFPSFNKRTGEILRIEKLKLNYGTQQPIHLALRACQKIHLVGRNGIGKSTLLKQIDQSAVTATDEIKLFANCFYLDQNFSFLLDHLSAVENLRNINPNITELEWRNLLGQLRIRGDKSTYPLAQLSGGEKLKVALLGLSHAQPMPELLLLDEPENHLDIESRELFANAISSYEGAVLLVSHDLSFVEKCGIVDSIYLN

SEQ ID NO: 7397 - protein, 257 aa, Acinetobacter baumannii
VEALSVARFSMFDHSFSFDCQDKVILVVEDDYDIGDIIENYLKREGMSVIRAMNGKQAIELHASQPIDLILLDIKLPELNGWEVLNKIRQKAQTPVIMLTALDQDIDKVMALRIGADDFVVKPFNPNEVVARVQAVLRRTQFANKATNKNKIYKNIEIDTDTHSVYIHSENKKILLNLTLTEYKIISFMIDQPHKVFTRGELMNHCMNDSDALERTVDSHVSKLRKKLEEQGIFQMLINVRGVGYRLDNPLAIKDDA

SEQ ID NO: 7398 - protein, 62 aa, Acinetobacter baumannii
PAKLKLMSKKTKIRALENLTLSKGELVSQTGAIFFNSWLGRKPTYIPIVSTTLSNIKATTLK

SEQ ID NO: 7399 - protein, 213 aa, Acinetobacter baumannii
TDFCQSTSLKKETDFKRFTTGKSMSKRDTIIKTATALFNEKSYNSIGVDRIIAESNVAKMTFYKYFPSKEKLIESCLYKRNSDIQSAILERININDLPLVQLRSLFNWYIDWIYTEDFNGCLFKKATMEVVQLYPSVKNPINEYREWLYELVFSILIKIQVEDAAALTNLFLNILDGVINDGTIDKNLINAEKTWSYIKKIIDLEKIEELVAI

SEQ ID NO: 7400 - protein, 242 aa, Acinetobacter baumannii
IWKLMRHLHHQTSQTKLWAVIPAAGSGSRFSKTELKQYQYIQDATVIEHTVKRLSQLPLTGYVLAIGKQDTFASTLSFQDKHKAHFCNGGVERVHSVLNALNYLSQIADEDDWVLVHDAARPCVTFECLNTLVKNAIETNQSAILAIPVRDTLKQVNQEQQIDKTVSRELLWQAQTPQIAKIGILKKAIETALKKNLTITDEASALESIGESVQVVMGRTDNIKITYPDDLELARLILQSQN

SEQ ID NO: 7401 - protein, 437 aa, Acinetobacter baumannii
TEVWAAFEQNNKKCKELHVIKEILLADTHNYHGILDERFIDLAHQFSRLQDARTGQGGAALAVYFRGQKVVDIYTGLKSQTEAWQPDTLAVCYSTGKGVLATLAHILVSEGFLEYDKPIATYWPEFAQNGKEQMTLRHVLSHQSGMFDVRNIIESAREMLDWSHMLDVVAATKPRFLAGEGNAYQALTFGWLVGGVLEKATGQSLDQLMQNYLVEPLQLDGAYFGTPASELDRVARLIIQPKPEKTASTQVEKPKKPQTRKSSLSEKVITWTGQDPQDFQDAMIPKGMKNFSFFSDEGLQAVIPAANGTFTANSLAKIYAMLANQGEWDGQQLIRPEIFKELSTIQSYARDRVMPIPMNWRLGYHRIITMGKRAKNGFGHIGYNGSGAWCDPERDLSFAYTHNFQIGSITGDYRLWGLTQEALRCTDQILKGRKGWF

SEQ ID NO: 7402 - protein, 200 aa, Acinetobacter baumannii
FSELMPKLKIALIDDDHARADYIKNSLLENDFEVVACLTLDHLNIFRLEDLQADVILLDMDHPHRDIIESCVSSYDLPTVLFTKNSDKDTIKQAIDAGVTAYIVDGIDPARLHTILEISIEQYKKHKKLEGDLKEAQTKLADRKDVEKAKVLLMQLHGLPEDTAFQLLRKNAMSHRITIGEMARRLLDAQKLLNDQLKDE

SEQ ID NO: 7403 - protein, 1008 aa, Acinetobacter baumannii
CFAWLLFAILKPTQAIMRLIHLSDMLGDHMTVDVTETISQTVHPAFQLLRQHHVEALDILVSEYKHKVTGAVHYHLATDYDENVFLVAFRTQPMDSKGTAHILEHTALCGSEKFPVRDPFFLMIRRSLNTFMNAFTAADWTAYPFATQNKKDFQNLLSVYLDAAFSANLNPLDFAQEGIRIELENGQPVYKGVVFNEMKGAMSAPSDQLYHQLAHHLFPETTYHYNSGGDPKDIPDLTYEQLVEFYKTHYHPSNAVFMTFGNQTAYELQEQFEKLALHKFTAGTTLYSKPEKRLTAPVEVTETYAVDGDELKDKTYHVLSWLLPQASDIKLRLGMRLVEGVLLENSASPLRHYLETCGYAQSTGPLMGVDDSNFEMTFYCGVQGSNPEHAQSFRDGVLNVLREVAAKPIDSSLVDAILHQIELHQREINGDGTPYGLSLILNGLSGAIHHNDPIQIWDVDSAIAQVKEELQDPMWLSNLIQTHLLDNPHRVQMTLVPDATKSAKEQEAEKARLAAIGEKLTEEDKAEIIAKTKALQERQDTPDNLELLPKVGLEDVPADLHIVQGQLREIICNRMDTPLNLYHAGTNGIYYQQVLIQIPDDVVKSPYFNLLSILMGEVGAGEYDYLELQNLQTAVSGGLGMGASLRSKVDDKDKISAWLTLTTKSLTQKFDAIHLLKLAFEQLRFDEKERIIELLQQRKTRWQSRLSGAGHSYAMQIASRNMSALAQRDYQNTGLGALNWLGELVTKITQDDAAYDALIAELKHIHTKLLQAPKQFLLVCEEHQSERLVEEIQNVWDKLNVDTAATELTQVEQENDNEHEAWLIQTNVQFCASAYQAVEVSHPDAAPLMVLAAYLRNGFLHSAIREKGGAYGGGASYDGNACSFRFFSYRDPRLAETFKDFEASVQWLLNTEQQPHQLEEAILGLVASMDKPGSPAGEAITACYALLHARTPTFRRTLRERLLHVTLEDLQRVARQYLIEQTPVKAVVAPFAKRDELQQLGFTIKQVN

SEQ ID NO: 7404 - protein, 120 aa, Acinetobacter baumannii
KVYCVKTVLVILTQANLTSLQVNESLAATMVLATFGSPVKVLLKDAALSLLQNEHNFDQLQHAFKIASNMVDSFEFYDLSPILVETKNKQHPFVQNSEQELEFVQLDTELIQSFDHVLYW

SEQ ID NO: 7405 - protein, 281 aa, Acinetobacter baumannii
NTNWYFYHATWRAIFLIINENTEDSLGMIQIDQLNYAYGHKQVLKNIHLEFPENQFSVILGRNGCGKSTLFKLMAGLEPVKDGLIRYSGKALSDFKGKDRAALLGFLPQFHKTVFPFLVKDVVITGRAAFSRYRPSKSDWERVDQALLDLDIEHLRDRPYTALSGGERQLVMIARILVQAPKVILLDEPTNHLDVYYQSYLMKKLRQLSRQNFTVIAIMHDPNLAFLFADHLFFMRQHEVVKPESKTRITDPKFLKSVYDVEFHEAMIQDKTIVIPDHSWL

SEQ ID NO: 7406 - protein, 232 aa, Acinetobacter baumannii
RAYCTVMSVEMPEIKIVRHVRARKLRLRVEPASIRLTVPLFCSKKQIQQFLAQSEQWLIETWNKQHHVQSTSFEIPSEISFFNREQPFQIVVQKQHRIFQFDWENSYLFIKDQQPYQALQNAVIAYAKQELPVLLSELSQKTRLSYAECAIRRPKTRWGSCSSQHNIMLHAGLVLMPAQITRYICIHELAHTKHFDHSPAFWAEVAKFDPNYMQHRRQLKGNPLPAWWYVTT

SEQ ID NO: 7407 - protein, 299 aa, Acinetobacter baumannii
SADCYGDEIMARIGFVGTGIMGMPMAMNLLKAGHQIKVWNRTSSKAESLKEAGAHVCSELEQIGKDVDFLICMLSDGKICNEILFQERGAISQLKPESTVIVMSSIPVEVAKTQSEKCKERGLRYLDAPVSGGEKGAQNASLAIMVGGDAQTFSHAEHVLSAMGRPILVGEVGCGMLAKLVNQMIVASTIATVSEGLLLASKAGADPIKLKQALTGGFADSPILQQHGERMLNRDFKPGGTARNQHKDIHTAVSYAKSLELNLPIAQKVSQLFENMLAAGDGELDHSGLIRELERMNHV

SEQ ID NO: 7408 - protein, 204 aa, Acinetobacter baumannii
CSLCRIQSGVRNMAYLNRDQRREMILQAAMQIALAEGFTAMTVRRIATEAQTSTGQVHHHFSSASHLKAEAFLKLMEQLDEIEQTLQTTSQFQRLFILLGAENIDRLQPYLRLWNEAELLIEQDIEIQKAYNLAMQSWHQAIVQSIECGQKEGEFKNRSNSTDIAWRLIAFVCGLEGIYKLGLQGLVEEDFKRHTEAIIRLELL

SEQ ID NO: 7409 - protein, 143 aa, Acinetobacter baumannii
NVMWFSYNKQDKLKTFKFKMNSLSNLQPVSKDLMIKIYILRTMMYCGVLWGLFDEGWAIKSDQEDFIFPFWLNGVQAHRYAKTHWPNYKPRKITPKDFHESLLPTLTRLKVTPALFNSSHRKLKLSTQQMHHFFFNHPKWQVA

SEQ ID NO: 7410 - protein, 244 aa, Acinetobacter baumannii
NNRCKMKLQFLQHTDLSNIIDTLISLSVAFVLGALIGFERQYRQRTAGLRTNVLVAVGAAIFVDIAFNLTGADGAVRVIAYVVSGIGFLGAGVIMRQEGNIHGLNTAATLWCSAAVGAAAGADLIIEAILATAFILSANTLLRPIVHIIDRRPLDDDTEVLHVIYIICDRSQSKVVMDELNLTLKHHNYPAKDIDVTPFGEKEVEIEVTLIATSIEAEEAQHIINHLNAMPQIRQAFWDKNTIN

SEQ ID NO: 7411 - protein, 172 aa, Acinetobacter baumannii
NALRGVFYKEFYMFKRNDEQSQQRPPLTGQRLRSYAFALLTRRDYSKAELIEKLARYAQNIEEVKQLVEELSEQNYQSDQRVAEQMLASQIRKGKGPKRIQQALKTKQIENDLIADEIQEIDWVEQAYQLKVKKFGEAVEKDPKLKAKQIRFLQYRGFDLDVILKAIQRKLD

SEQ ID NO: 7412 - protein, 365 aa, Acinetobacter baumannii
IKNRILQISGMIMDNVAQLETDTNFQSRKKITWGVFSVLLLFLVAGILYYFFVYRFYQSTDNAYVQADVTWVMPKISGEVLELLINDNQVVKKGETLAVLDHRDYQARYDQAHSVVSLKEAALGVQQQNEKSARSSIIEANSGVVAAQADLARLKKEFERYQDLLKDGVITRQNFEGIQSQYLTAQAQLSKAQAAVNAAEAQLGSLQASRAQLLADIQSANANLNLYQVDLASSKVVSPVSGKIGSLAIQKGSRVSPQTRLMAIIPENSLYVQANFKETQIEKMHIGQKVKLKLDAYPSLNFTGKIESFSPASGATFSLMPPDNATGNFNKVVQRIPVRIAIDSSPHIDLIKPGMSVSATVDLRT

SEQ ID NO: 7413 - protein, 576 aa, Acinetobacter baumannii
FWLLLGKVCASKTLGICSHMASPAQIIRHKFLNTFFSRHSIWFLCIFTALTITWFRTVYTPHSIYYFISDTLLNGLWVVSGALSLLGLYDVLQNRHSILRNYPIIGHFRFLFEDIRPEIRQYFIEADQDALPFSRMQRSLVYQRAKNENADKPFGSIIDVYQEDYRFIVHSISPCPPADPKSFRIQIGNAQCLQPYSASIMNISAMSFGSLSANAIRALNKGAQLGGFYHDTGEGSLSPYHLENGGDIVWQIASGYFGCRTLDGKFDEQKFAKQSQLPQIKMIELKLSQGAKPGHGGILPKHKITAEIAEIRGVSRDHDCISPAKHSSFSTPIEMMHFLQKLRTLSGGKPVGFKLCIGQPWQFMSIVKAMLETKIVPDFIVVDGSEGGTGAAPIEFSDYIGTPLREGLRFVHNTLVGAGLRDQVKIGASGKIISAFDIASTFALGADWVNSARGFMFAVGCIQAQSCHTNQCPVGVATQDKDRQKALHVPTKAERVFNFHKNTLHALSEMIAAAGLRHPSDIKAHHLAQRINDREIKNYAQLHFFLKEGELLQSELKNDDDNFYYRMWNMADANHF

SEQ ID NO: 7414 - protein, 197 aa, Acinetobacter baumannii
TCFRRFCACCCYLIKIKNKINIKDIFFYKVKYILNLLILYNFILSSNYYDHRMQKINIDRHATAQINMLANKLMLKSSTAYTQKFGIGMTEWRIISVLSSASDCSVQKISDILGLDKAAVSRTVKKLEEKKYIEVNGHSEDKRTYVINLTSTGQELYDVASDFALEREKQLLEELEESEKDQLFNLLKKLRNKVDQM

SEQ ID NO: 7415 - protein, 280 aa, Acinetobacter baumannii
PVMLILVLRLTVKSLTWLTQPIPWLVLATFFRSGNMKQVVLVTGAASGLGNVIAEYFASQGHQVILSASTLEKAENAKAQSQYAQNMFSLKLDISVEADFHAAVQWIEEKFSKLDVLINNATVTKATPVLEITAADFDWVTQVNQRGTFQACQIIGQYMAKKGYGRIINMASLAGQNGGTATGAHYAATKGAIVTLTKIFAKEFAAKGVTVNAIAPGPMESPIVHSVVPDEKMEQFIQNIPVKALGSMHFIAETCGLLASPNASFVTGATWDINGGLFMR

SEQ ID NO: 7416 - protein, 304 aa, Acinetobacter baumannii
IGVLVHPFFIQEFINYKRLGMNTRHFSQLPKAALAYPKVVQGLIFKKPKGPKILPQVEYVVDTLEIDQNHLKAYNEVCGFQNNGFVPAIYLAVLSQSLQMHMMTAEAFPFPILGLVHIRNQIKQTRPIGVTEKLTLSCKFGELKPHDKGVQFDFITTAKVGNEVVMEGLTTYLSRQKVEKRVGEKAKEEQVPAYVPKAEWNILENTGRRYAKVSGDFNLIHIHAITAKAFGFKQAIAHGMWSKAKALANLELPNAYEADVWFKLPMFLPSKVEFLTANADKKTDFLIRNAKSQKPHVAGTVKAL

SEQ ID NO: 7417 - protein, 116 aa, Acinetobacter baumannii
LLKRATLLKSSLRIKEIAMKIRASRTYSTYSNNYFISKEYECSVIPVKGMCFTDLGLTENGVIQPVEINEVTIDPASNSYHILLAKDSHEYTKEELKRKFEEMKANGWEYIEDLLV

SEQ ID NO: 7418 - protein, 139 aa, Acinetobacter baumannii
HHMRTNKRQTNLKDIKASFQQSGYVDWHFNPRLSDSQNEDHDGEVVVQTAPPELKRPPLYAVVLLNDDYTPMDFVIEILQQYFAMNLDQATQVMLTVHYEGKGTAGVYPRDIAETKANLVNNYARSQGHPLLCQIEPKA

SEQ ID NO: 7419 - protein, 155 aa, Acinetobacter baumannii
KNQRIIQIIKTYIVKSAYMSSIVYAFVGGLLLGTATVGYLYINGRIAGISGLLAQFISPSRDIFKSSAFWFIAGLVITPFIYGYFYQPEIEIKANSFVLILAGILVGFGTRLGSGCTSGHGICGMSRLSKRSIIATAVFMFASMLTVYIIRHVLG

SEQ ID NO: 7420 - protein, 216 aa, Acinetobacter baumannii
DFWRVITEFTVALKSEILARQPNALGLAKLVFRPDSGDPVKIICGDPDAEVGSPAYKGAVECLWEVFGGTTTDQGYKVLNERVGLIYGDSITLDRAQRILEGLEAKGFASNNLVFGIGSFTYNYLTRDTFGFAVKATWGQVNGIGRELFKDPITDSGVKKSAKGLLRIEESENGFTLFDEQTAEQEQGGALKTVFENGKLQYDCTLDQIRERLSIA

SEQ ID NO: 7421 - protein, 813 aa, Acinetobacter baumannii
FNILLSLLALIAFFTDDLTGSTIISVMVILSTLLRYWQEAKSNQAADALKAMVSNTATVLRHQVSAEDLELMHERYGIDTKNQTIHQFEIPIQYLVPGDVILLSAGDMIPADCRILSAKDLFVSQAAMTGESMPVEKFPLQKNLEETSALELGNIVFMGTNIVSGSAQAVVLSTGIQTYFGALAHRVTATDWSTTAFQMGVNKVSWLLIRFMLVMAPVVLFINGFTKGDWAEAFLFALSVAVGLTPEMLPMIVTSTLAKGAVFLSKKKVIVKRLDAIQNFGAMDVLCTDKTGTLTQDKIFLSQHIDVQGGKSDFVLMQAFLNSYYQTGLKNLLDVAVLEAVDDQIKIQKLRYKKLDEVPFDFDRRRMSVVVQTPQQKARMITKGAVEEMLKICRYVEVNGKVEPLTKQREVAIEALTQRYNRDGLRVVAVAYREFKNHQENYSVVDESDLILIGYITFLDPPKESAKEAVQSLHAHGVTVKVLTGDNEFVTQKVCREIGLNYDQILLGGVIETLTDQQLKRAVEQYHIFAKLSPVHKERIVEQLKANGHVVGFLGDGINDAAAIRAADIGISVDTAVDIAKESADLILLEKSLMVLEKGVIEGRRTFANMLKYIKMTASSNFGNVFSVLIASAFIPFLPMLPIHLLIQNLLYDVSQIVIPFDNVDEELIAKPQRWQPEEVGRFMVVFGPISSIFDMITFGLMWFVFSANTPEHQTLFQSGWFVVGLLTQTLIVHMIRTAQIPFIQSRAATPLLIMTAAIMCIGIFLPMGPLASYLKLQALPLSYFLYLPLILGAYMCVTQWVKKIYIRRYGWQ

SEQ ID NO: 7422 - protein, 60 aa, Acinetobacter baumannii
YNIFYLKTIYKSISIKKHNIICDLYLINYLICINRLYFYIYFIKTIIKSHFTNINVSWLL

SEQ ID NO: 7423 - protein, 69 aa, Acinetobacter baumannii
SCIFDFLSYIRFMYAMAIKGAISSGRSTILFPLVFEFYTKCKAFILHLVAELLEIYLKYQSYFLDLCIL

SEQ ID NO: 7424 - protein, 339 aa, Acinetobacter baumannii
GCILLKILKWSAVKMKRKVLITGPTLTSDALLYAQSHDIQLIPTEPYMAKDKMEKLIHDEQPDAIIVRTGKLSRDMIFASDNLKVIAKHGVGFDTIDTQAAAERKIPVTIAVGANAQSVAEHAFALMFNVARQVTWLDQRIREGHWDKASANGMELYGKTLGLIGLGAIGSILMKLVAPLNMKVKVYDPFLQNLPELDYVEQQHDFEKLIETSDIISLHCPLTAENKHLFSHAQFEKMKSSSILINTARGELIDQAALVDALKNNKIAGAGLDTFSSEPPEKDNPLWELPNLVVTPHIGANTTDSRNRVGLLALEQIVSIWNGQLLNPRAIANWKLLNS

SEQ ID NO: 7425 - protein, 167 aa, Acinetobacter baumannii
MLFRAMANKKLLICAAIAAGLLLTACVKKETPKEEEQDKVETAVSEPQPQKPAKFESLESVDTQEAQVQEQPQVEVHREETANTTTEIHRETRPARSDESSQTQVAEQPKSETPKVEPKPEKKPEPKAEPKPEKAQSKPAAKATEPANTEDDAVAAAIAAATPALKN

SEQ ID NO: 7426 - protein, 368 aa, Acinetobacter baumannii
KIAREYFMKSKLGISKQLFIALTIVNLSVTLFSVVLGYVIYNYAIEKGWISLSSFQQEDWTSFHFVDWIWLATVIFCGCIISLVIGMRLAKRFIVPINFLAEAAKKISHGDLSARAYDNRIHSAEMSELLYNFNDMAQKLEVSVKNAQVWNAAIAHELRTPITILQGRLQGIINGVFKPDEVLFKSLLNQVEGLSHLVEDLRTLSLVENQQLRLNYELFDFKAVVEKVLKAFEDRLDQAKLVPELDLTSTPVYCDRRRIEQVLIALIDNAIRYSNAGKLKISSEVVADNWILKIEDEGPGIATEFQDDLFKPFFRLEESRNKEFGGTGLGLAVVHAIIVALKGTIQYSNQGSKSVFTIKISMGHEEIG

SEQ ID NO: 7427 - protein, 338 aa, Acinetobacter baumannii
NAYSIVDFFFPTSTQPTTDNCCNSKQLLWSSYMALRHFLTLRDLSTLELNRILERASELKKMQQSNKVYQPFVGKVLGMIFEKSSTRTRISFEAGINQFGGSAIFLSPRDTQLGRGEPIEDSARVISSMLDIVMIRTFGHDIVERFASYSKVPVINGLTDDHHPCQLLADLQTYIEHRGSIEGKTVAWIGDGNNMCNSYIEAAHMMGFKLKIASPKGYEPKPEFLAEFGHCVELFDNAEDAAVNADLIVTDVWASMGQEEEQKLREKAFANFQVNEKLMGLAHPDCLFMHCLPAHRGEEISETMLDHKNAVVWDEAENRLHAQKALMEFLLNENLKKA

SEQ ID NO: 7428 - protein, 213 aa, Acinetobacter baumannii
ILYRKGNRKYMIIEKLKSISSITELVSVFIIINFIVQVSLKVRFLNVYGYWTISLFNPIEIMFGNLELMLIYILIFSSIIYEKSLAQMVYMVLCITILPYIIPMLLHKYYLSPLSIYGVIVGLMGIFITKFAKQNSTSEIASLTILLIIAPLLFGIHLNNRLNTNDLSFINLKDQTSEKWFILDKFSDSFLLINEDKSKLKIIKIEEQKSIIL

SEQ ID NO: 7429 - protein, 144 aa, Acinetobacter baumannii
IMNRKLISTIVLISVFGVTACSKASNEQTKIDTTAKSSSQNVKTELSESDKAILDRYETITNEVVMSGEDEKIKQTLVPLIPEIKKVTAKKQREMALMNIYMLSGMYKEAYELNEQQIQEKPLPQRVMFRCTLLEKLNETKVKI

SEQ ID NO: 7430 - protein, 294 aa, Acinetobacter baumannii
MANRSNHNQELAQLVDQWTREKGTFETAITGLTLFRADTLTKPNSSMMDASLCMIAQGKKQVILSEETYTYDSNHFLFTAIDLPVIAQVLEASVEQPYLSIVLRLDPYLLAQIMLEAHIPFKDVNTEKKGMAVGVVNSELNDAFIRLIKLLDTPQDIPILSPLIIKEIFYRLLMSPQGDRLKRIVAAGTTGHRIVKAIEWLKTNFAKPFSIEELASTMGMSASSFHQHFRDITSMSPLQYQKRMRLTEARRLLMTEEYDISSTSMQVGYESLSQFSREYKRFFGVSPSVDIKNI

SEQ ID NO: 7431 - protein, 67 aa, Acinetobacter baumannii
VSCRSCRGASVTKYAERYLLLSCFRASLKVFEQIFSSAFELEQSIDSAKTSDEHKQLNVTTKLNLFN

SEQ ID NO: 7432 - protein, 77 aa, Acinetobacter baumannii
KCRSMGRSRKPSACTKSFNGIFTQRKFEKSLISNSKNSIVKVLFFYFYKIPITLIYYFKNFYDVAQYINSLYFNCHT

SEQ ID NO: 7433 - protein, 475 aa, Acinetobacter baumannii
NKWLGGPMSSFDEIQNREAGLHKKLSAKQMGMIAIGGAIGTGLFMGSKFAISFAGPAVIVSYAIGGLIAFALMACLAEMTVQHPTSGSFGAYAEHYISPLAGFLVRYCYWACIVLAVGTEITAVADYMKLWFPNVDSWVWIGFFSLTLLVVNAYSVKAFGLVEYWFSTIKVFAIIVFILLSIGILTQSNQGMTQVVTHLSGHGGFFPNGFSGVWIGVIISIFSYLSIEMIAVAAGEAKDPEKAVKKAFKSTALRLILFYLLSLFLIVTLVPWTVLIGADATSPFVMVMKIVGIPYADSILNFIVIVAALSAMNSMLYISTRMLFSLSRAGDAPKVFGRISSNGVPVNALLLSAVGIGIASIVYTINPASAFPIMIALSMFGALFTWGSIFVTHMFFRRHMVQQNIQLKFKIPASRFISLFGFIAILSITVTTWFTSEFKSTLQFGVPLVLVLIFFYYLKRSTVKLNLNSSEETLK

SEQ ID NO: 7434 - protein, 272 aa, Acinetobacter baumannii
ICCRSRQASSSERSRIDEGLIFMTDSEEYHLPQHVAIIMDGNNRFAKKNQMQKGDGHREGKNVLDPIVEHCVKTGVRALTVFAFSSENWNRPQYEVDLLMKLLEETIHEQIPRMKKFNIALRFIGDRSRLPSHLVALMEDAEQQTAHHDAMTLTIAVSYGGMWDIANAAKQVAQAVSRGEIDADQINVDLFEKYVSLNDLPAVDLLIRTGGDFRISNFLLWQAAYAELYFTDTLWPEFTVEEFDHALNVFSGRERRFGKTSEQIQQEKIEKL

SEQ ID NO: 7435 - protein, 66 aa, Acinetobacter baumannii
RTCRYSCGFNRFNSSLFTCKAETFLLLKFEAAYRGSFSFNYLKMIGVSHIPHTIIEIIIIIFQFRL

SEQ ID NO: 7436 - protein, 705 aa, Acinetobacter baumannii
LFSSFRHVMTSMSNTTQKHFIVEQFPLPTWVSDEKGLILYCNTECTKYWRDTSPPLFQQWLDFVYPADLEEVKNKWLDAIRLRSRIEFKCRLLHKTHYYRWCKISIQLSKYHESSQENEWFISFLDIDQDIQEQQSLRKDIDIQNQMLDISVDCIKVLNTDGTVSHMNKSGCLALGVPVDEKKFGMRWLDLLPPHIRKRGRVALKKALQGKVARFAGMSCLPNQEPEYWDNMLTPIQHTNGEIIQILCVSRNATQQYLTENRLRDISERDELTGLFNRRSFKLQLKRTLAYSRETQTSVGLLLIDLDHFKHINDTIGHSAGDHLLKILSKRFNQCVDPERCSVARLGGDEFAVIVSHLENENDVRELAEVLLQQLNQPITYAGNVLNGGMSIGCAIYPQDAVDQSSLLSCADMALHDLKARGRGGIRMYNPSMMQLTEAIASQLNIARQLIRHHTIQPYYQPKVDLKTHAVVGFEALLRWHTTSAQRGLPSQIAEAFKDYDLASKIGEIMQQQVLHDIAKWIKLGFEPLPVSLNAAPVEFLRDNYAERLLKKINQLEIPTHLIEIEVTEHMLGDRGSEYVIRALNKLKQHGVRIALDDFGTGFSSLTHIRDYPIDCLKVDCSFIQKMQHDPSIYAIVQAIGLLAPNLSLGLIAEGIETPEQEELLLQFGYNIGQGFLFESAIDANQVISILKQGQAYLESHYSMN

SEQ ID NO: 7437 - protein, 395 aa, Acinetobacter baumannii
SILRIKRFFMFVYFPKNYVWSMSTVIAATHGGSIGEIDEFCRPLLEKSSDDADVGTVEFLHAWIGGADKLIRMAEQDLEKNRELSAAKKYYRAALYYLIAERMQEQGHPERLKVYKRYLELAELYRKYKKDDVKRVEIPYQNSHLSAIYAKGKTTDEKQAIVVMMNGLDSTKELMSYSPLADELVERGISVLMVDQPGTGEAIRLQDLRAVYNSEIWATPIVDWLCEQPEIDQNRIAAFGISLGGYYCPRAVAFEPRFCCAAIWGANHDWRAVQQARLKREGENPVPHYWKHVEWVFGAKDQKEFFEIAENMHLNGILDRIKVPFLVTHGEKDRQIPLKYAYETYDQLINSPDKELLVIDDEMGGVEHSSIDNPLNAGAYIADWLAEHLGGRTSK

SEQ ID NO: 7438 - protein, 382 aa, Acinetobacter baumannii
ESISLKEVNMSVIDVGGEVRDGEELDIGAVENWLKNQGVELVGPAVVTQYTGGASNWTYRLKYENTDLILRRPPKGTKAKSAHDMAREYMVQKNLAPYYPVLPKMVALCQDETVIGCDFYVMERIEGIIPRAKLPPELGFTEEDVHELCVNVIDKLIELHQVPYENTPLAELGKGTGYCRRQVEGWDKRYEKVRTINVPSFKYVRKWLNDNIPQDSTTCIIHNDWRFDNVILDPKHPTEVIGVLDWEMATLGDPLMDLGSALAYWVEPTDNMIFRSTRRQPTHLKGMFSRKEVVDYYLQKTGLEPQNWTFYEVFGVFRLAVIAQQIYYRYYHKQTRNPAFKDFWIVIHALHIRALKLIAQQKLQESEFAQQSLQKIQGILRR

SEQ ID NO: 7439 - protein, 301 aa, Acinetobacter baumannii
LNKRTKKGIMEIKVLVDVKTKLGECPTWDAVRQRLFWVDIVDGRLFCCDEFGGNIRAWEVHKKIGSFALQENYNGAIVALEDGLYQLDFDTGNLKFICNPEPDLPQNRLNDGRVDRQGRFVFGSMNRLEDGNTASLYRLDADYKIEKLENNINTSNSICWSPDGAKLYFADTWQGEIWSYDYDLETGQISNKTIFCKIDTSDGGSADGSTVDREGYLWNAKVYSGQLVRYRPDGQIDRIIEMPVKKITSAVFGGKNLDVLFVTSMSQPPLPRFSDDNQLRGSVFAIYGLGIQGIADARFMG

SEQ ID NO: 7440 - protein, 209 aa, Acinetobacter baumannii
VEKRLLSCLRHENKKRKANGEPKKDSILQDIKTIHERPAEVQERKIPGHWEADLIKGKDNKSSIATLIERNTRLCILATLPDAKAESVRKALTEALKYLPAELRKTLTYDRGREMSEHKILEEDLGIDVYFCDPHSPWQKGTCENMNGLIRQYLPKGIDLNQADQHYLNQVAMSLNTRPRKALDWLTPLEKFAQLVDYHMAFETVAPHV

SEQ ID NO: 7441 - protein, 159 aa, Acinetobacter baumannii
HDRSSCFSNLSGDLLMTKPVLKTRDQFKFFLDIQTRWADNDIYGHVNNVTYYSYFDTAANALLIQKTGFDIHEAKSIGLVVDSACSFFQELSFPEVIQVGVAIGKIGTTSLRYELAIFKQGQDQASAQGHFVHVFVDRETRKTVPISESVREVLENFLL

SEQ ID NO: 7442 - protein, 264 aa, Acinetobacter baumannii
PFILIKKPANMSAFLSFKLIIFYIYIASLYLKENIIKNKALTKYKRTTMAQFAVIGLGSFGATVAQELTRLNHDVIGIDTVKKNVENLADVLTHAVIADATDEHVLDELNIQNCDAVVVAIGEDIEASILCVLNLKNLGIDKIWVKAKTKAHHTILSHLNINKIIHPEEDMGVRVAQALNYPMVSRYMSLEDDHYIIKIEIPDKLNGINLYGIMQQAPQVKTLLVKRQQQILFETEENFTLQTHDILILEGHLSQLKKLSNCFL

SEQ ID NO: 7443 - protein, 230 aa, Acinetobacter baumannii
ILQRREQMTLRLSVAAMGLLLSGSVFSAVTITAPEEVVILAVNGQEVNSGLFRSSKNNYKVDAGETSLSVRYQEYFEHLSGEHDIVKSGVVTIQTPALKDGQTYKLAMVDAPKQFEQAKKYAEQPTVALYNSNNELIVQQTGANNEARPWFASGLLGKVTDFTTKSSKQQPDAVYAAAKPTTTQANAPVATTMPATGVAQTNDQRLAEIWKKSSKAERQKFMAWLAEQSN

SEQ ID NO: 7444 - protein, 311 aa, Acinetobacter baumannii
CIWRIIMPYYTMPDQESLFVRRVGRGEPVLVLSGLGMQSWQWLPFIYANRKEYEFIIPDWRGFGGSKNCAIPEQDAISSHWQDVAHLIEQLKLDKFILMGYSMGATTAMHGMKHAHLAQQLKAYLHIDQTPKISVDATWQYGLFGPLHAQFKQLLNDIYQLLSIHKNAKYLYELSLPDRQKLVRLWVDFIELQSSNPFSPFVFKTALKQPFLQKYLLPIQRLDYLFWYVENYLFHNEDYREALQQLQCPTTFFIGRNSTLYPETGQTLIAHSVEHAKTIYFERSGHTPLLTEPKKFGHEITTFLSELKHAS

SEQ ID NO: 7445 - protein, 229 aa, Acinetobacter baumannii
AQWSCLMIDKSKSSLSEVLSQIKDGATILIGGFGTAGQPAELIDGLIELGVKDLTIVSNNAGNGDYGLAKLLKAGSIKKVICSFPRQSDSYVFDELYRAGKVELELVPQGNLACRIQAAGMGLGAVFTPTGFGTLLAEGKETRHIDGKDYVLEYPIKADFALIKAYKGDRWGNLVYRKSARNFGPIMAMAADVTIAQVSEVVELGGLDPEHIITPGIFVQHVVQVQPAQ

SEQ ID NO: 7446 - protein, 223 aa, Acinetobacter baumannii
AIRRNNMSYQKLSRDQIAKRVAQDIPDGAYVNLGIGLPTKIASYLPADKDVFLHSENGLLAFGPPPAAGEEDPELINAGKEFVTMLEGGSFFHHGDSFAMMRGGHLDIAVLGAFQVAANGDLANWHTGAPDAIPAVGGAMDLAVGAKKVFITTDHVTKQGEPKIVAELTYPVTGKHCVDRIYTDLCVIDVTRDGLKVIEKVEGLSFDELQALTGATLIDATQG

SEQ ID NO: 7447 - protein, 223 aa, Acinetobacter baumannii
AIRRNNMSYQKLSRDRIAQRVAQDIPDGAYVNLGIGLPTKIASYLPADKDVFLHSENGLLAFGPPPAAGEEDPELINAGKEFVTMLEGGSFFHHGDSFAMMRGGHLDIAVLGAFQVAANGDLANWHTGAPDAIPAVGGAMDLAVGAKKVFITTDHVTKQGEPKIVAELTYPVTGKHCVDRIYTDLCVIDVTRDGLKVIEKVEGLSFDELQALTGATLIDATQG

SEQ ID NO: 7448 - protein, 220 aa, Acinetobacter baumannii
QVRRKTMKRCLLVLLLGLGLAACNDNDHDDQVSTEKPALAPSLDVGTYIISTETDQELPMAGKYYSGADGTKLLVLDDDENRAKIVMSYDAKTKAWRSNQSNQAMTVELAHYEKIADQKLLLNQLVGTYDLSFPDGTTVNAEVNAQGKIVSKDPSCVFTGVITESALANTANYQLTDNQCDALKNNSKGYVVVDEDLDPMSFRLVSDTIASKDIWAFAQS

SEQ ID NO: 7449 - protein, 125 aa, Acinetobacter baumannii
KTRRITMTNTIDGFVFDNPPKEEQIIELAHYHRKLLDEAIFHQEIHLGDYCLAQRKRVFDYARQLDPNQKAWFYQVYDGELRKIADEDELHPADAEEGLSIFAMLLVLVIIAAILYFSVIRSLMG

SEQ ID NO: 7450 - protein, 293 aa, Acinetobacter baumannii
LLHGKSAFMNSIKNKEEYQKALAHVIQHAEFNEDIVEFVDYVTSQKGNIPFCIRRLRSYCEANAIVSWFRDKDLIGFKQWCYIAAKLNRMVIQFDPIGWFPAYEHFSALLSDNEEIISWYSQHRVSYDRQGSIKDRDNPRKPDFHGYQLILALNHEWDKLRERCELILQTDLKKDKKYLIDHRFYLALANGDKNEIENVLTELTSPKIAKVRNFEFAFTFTEHFIATHAVIYTKLAWRNGYQLNIDTPWIPKEWLPVEPLLEYPEPWEFMREFDIFTPFEGEWKDWSPKRDNR

SEQ ID NO: 7451 - protein, 520 aa, Acinetobacter baumannii
TVIGKMNMLSRVVRQILQATVYDVAIETPLEAAPRISQKLNNTIRFKREDLQPVFSFKLRGAYNRISQLPKEQLERGVICASAGNHAQGVALSGQRLGIPAIIVMPSTTPDIKVQAVKRLGGQVVLHGDSFDIANKYAQQRAEAEGLVFIPPYDDELVIAGQGTIANEILRQWRDVEYVFVAVGGGGLIAGVAAYLGDVAPHVKVIGVEYEESACLKAALEANERVVLPHVGLFADGTAVAQIGALPFDIVRLRKSDNSGPIVEPDIVTVNTDEICAAIKDTFDENRSIVEPSGAMALAGIKKYVAEHKISGKNMVSIVCGANMNFDRLRYIAERTELGEQREAIYAVTLSEEKGAFLGFCRALQGRNITEFNYRANNTEEAQVFVGISLKGGDTERHEILEQLKQQNYVVDDLSDDEVAKLHIRYLIGGHANLDDERLFRVEFPERPGALLTFLTRLGPTHNITLFHYRNHGAAEGRVLVGLQATDAKQNPDGLIETLEQISYPYAEITDNVGYKRFLK

SEQ ID NO: 7452 - protein, 411 aa, Acinetobacter baumannii
IMSGCGAERGLISIDEALDLVINKPKNLSSIQKTLINSLSSYLAKDIYSEINLPSFSQSAVDGYALCSHAEDLNNQKFQVTGEIRAGSESHDILGEGQAIRIFTGGKIPEGTTHVARQEIVSVSAQEVCLTEHIRPQADIRFTGEEIQQGQLLAQVGQFLNIGSLAALSMAGVQELTVYRRPKVAVLVTGDEVAQTAEDLIDGKVFDANGPLLKAWFKDYGLDVELIHVADEADQVTHYFNQLKDSYDVVITTGGVSVGDYDFVRPCAFEVGFEQIFWKVKQKPGKPLFFAEYHNSQAIHSCYLLGLPGNPAAVYVAMQVYGKSLLDALQGNRQGPEWFTAILEHDLKEDARERFLRMYAYFDAGQLRVKSLAKQQSHMLSNLMQANCLVRIPASTKLASGTVLTGIFISN

SEQ ID NO: 7453 - protein, 932 aa, Acinetobacter baumannii
IGKGAVMNSIPSVEIDSSDHVAKTTKTTCPYCGVGCGVSVNVQQKPQGPVVQVEGDAEHPSNFGRLCIKGSRLADTLGLETRLLQPMFGRKPLRTVTTWDAAINKIADKFQSCIDKYGRDSIAFYVSGQLLTEDYYVVNKFVKGYLGTANIDTNSRLCMSSAVAGHKRSFGEDIVPASYEDFEHADMVVLVGSNTAWCHPVLYQRIMQAKSHNPDMFVVVIDPRFTSTCEQADLHLPILPGQDVALFNGLFQYLYQNGHADQAFVDAYTEGLQEVLASSQQETDIGYVAKRSGISLDKLQQFFEIFAQTEKVITLFSMGVNQSSQGVNKANSIINCHLLTGKIGKLGAAPFSMTGQPNAMGGREVGGLANMLAAHMDLDNPLHQKVVQTFWDSPFIATQAGLKAVDLFRAVEAGKIKAIWIMATNPVVSLPDADQVKRALEKCELVVVSDICADTDTTAYADILLPALGWGEKDGTVTNSERRISRQRTFLPAPGEAKADWWSVSQVAKKLGFKGFDFNSAVDIFNEHAALSAQDNADIEAREQTDTFRYFNLKGLMSLSIAEYDALQPVQWPVWDKKQDAKAVQQLFGKGQFSHKNTKAKLIPTVAINPVHAISEDYPLILNTGRIRDQWHTMTRTGLSPNLTSHRAEPFCEIHPSDALKFGVRDQGLVEVRSKWGSCVLRVTFSSGVRRGQIFAPIHWTEQVASDARIGKVVNPEVDAISGEPEFKHTPVTIQPFYTTWQGVLYIREGYDSHIQESLHHCAWWTKVKMVKTNRYELADRQTFHDTQKNLKSFLPFADETFEWLSIEDISSQLSHSIILKDGIVIASLYIAPPDLLPDRDWVASLFKRERLSALHRKALLAGMPMSATNNDGPLVCSCFKVGKNKIIEAIKTQNITHEKQVTACLKAGGNCGSCLPEIRGLIKACQQEVEV

SEQ ID NO: 7454 - protein, 153 aa, Acinetobacter baumannii
QKRGEHMTYKYEYAGFWLRFGAMIIDTLILFLAIIPAAWIFYHGDYDLIFATGMSSKPQNYWFDMIVNYAFPFLYTVLCWIYFAGTPGKRLMRLKVLDEKTGNKLTFVQSLIRYIGYIPSILVFCIGLIWVAFDAKKQGWHDKMAKTVVVREL

SEQ ID NO: 7455 - protein, 348 aa, Acinetobacter baumannii
LSRGALMSEIPFLNPAVLKQLDLPVPNRELTPQVLSPLNLNTLEEPSRELLAYRKLYGLHLLDCEHWQGYVQMPLFRLHVQVFKPKLDKIQGTVCLLHGYLEHSGIYQPIIREILEQGFSVITYDLPGHGLSNGSPASIQNFDHYQQVLMAVYQYVKHADQLPKPWVGIGQSTGGAIWMHHLLEYAEKRQDPIVDRVLLLSPLIRPAKTAWWHNPVGLGIIRRIKRQVPRHFRRNNHNPEFLRFIRLKDPLQPRMMGMDWILAMSKWMQEMEERPACRIPVWLAQGALDQTVDWRYNIEFIRRKFRLQTLLMLEEGSHQLINERADIRAALTGLIPAFLHAKPKHFYY

SEQ ID NO: 7456 - protein, 271 aa, Acinetobacter baumannii
LIAGFLCPHGNPVLCSTFLNLSWLRTRKMKLNSYNFLLGLAFASSVAAPAAQAEIVIHGTRVIYPSDAREVTLQVSNNGSKPALVQAWIDEGDPKSTPDQSKVPFMIAPPISRVEATKSQTLRITALPNASQFNQKQETVLWLNVLDIPPRPTSKNADTTPDNFLQLAIRSRIKFFYRPASIKEDANLAADKLQWVKSGQNLTVKNPTPFHITMTSVYQKVGDKKVDLLPQGLMVKPFSEASIQLKNSNLQDMSFINVNDYGGRVEHQIKL

SEQ ID NO: 7457 - protein, 397 aa, Acinetobacter baumannii
SLKGLFKGIRMMHKIESKRGMLALMTSHCAGMVDLVALPIWIGTLIANYHFGFQQAGGLVTLFLLGAMLASLIFAPIFNRFNPKWPVFIGFFSACCAFYLASKNTHFSVLAILHLVGGFSAGLALSFTHGTMGRGLNPHRIFGFAGLALGIFAILFLAGSLNLIRNFGGSTLFLILASIMAVAAFIAFLFYPQVNKKQDNIQFEAYHRPKFSKYIWCCIFGISLLAMTNSMNVSFYERIGIARGFGESSVALTLIIYSIVSIFPAPIAAFTQKYLNPLAVICIGPIFQAIFSLVLTHSHNYFLYTVAGSCMVFTILFTHTYAFGLLARLEPTGRAVAGTPAMLMFGAALGPILAGTLVQYISFEAIGIMGCILVVGQLILFNIVRAYYSNNGLAQNA

SEQ ID NO: 7458 - protein, 324 aa, Acinetobacter baumannii
TRLIRLGIVMAKILTITLNPAIDVTIQLNELLVGEVNRQESVEIHAAGKGLNVAQVLKDLGHDVIVTGFLGEHNRQIFDTHFAQAQFQPEFIYIDGETRQNIKIAEHSGRMTDLNGKGFFVSETDKQSLFNKIEALLPQVEVVAIAGSLPQGFSIDELQQLIQLIKKNNKKVALDTSGKALVAAIECQPWMIKPNTDELVESYQRPATSYAEQRELFDSLTNIEHVVISMGEDGVNWLHATHPLHAQAPKVIVKSTVGAGDSLLAGMIHGLVNQLPPEETLKTATAIASHAVTQIGFRIPTSEVLNQLKAQTIINSLSESDANC

SEQ ID NO: 7459 - protein, 369 aa, Acinetobacter baumannii
MNIISQSVQKGRGKLKVMVKDTIDIQGLKTIAGSRALLEVEPAHDDAEVVKNILKADCEIIGKTNLHELAFGITGINHAFGTPINPKYPELIPGGSSSGSAAAVAAKQADFTLGTDTGGSIRMPAACCGVYGLKPTFGRVSREGVYPPSSSLDCVGPFANSVEMIEKAMQIIDPTFKPAECTLTPKLAVLDVKADEVVWNCIYQTLQKANLETVLEKVEHFEAAYDAGMQIINYENWQAFGELTQTGLIGSDVNGRLLKAAATTLEQVKQAEVVRAQLTQELDALLEKYDALVLPTLPQIPPKVSEAENTVAFLNLTGLVRPFNLSGHPAISVPLETSEGLPVGLQIVSKHQKDEQLCAIAKFCVDAMQ

SEQ ID NO: 7460 - protein, 204 aa, Acinetobacter baumannii
LVIMTVNRRRPKHDPKESEREILNAAEKFLSERPFRELNVDEVMKLTGLKRPAFYVHFRDKYDLALRVVQDIGQELFTLANHWLKGNNFPEDSLQALQGIVNVYQKHGAVLRALSDAAGADERVEQIYRSLIQDFITATARHICEEQENGRISLELNVDETARALVWLEERYLSEAFGRTPQADPIVVVQVLHNIWISTLYRTN

SEQ ID NO: 7461 - protein, 177 aa, Acinetobacter baumannii
SAIMTTLEQSLSEITAFSIIHEHLFSSAQPSIEQLKLIKEYGCSTVINLALSNSPDSIKNEDQVCLEYGLNYIHIPIDWETPSSDQCLLVLDLIDHLVQNEIVWIHCAKNKRVSCLMYVYRQFYMNMDMPTCQDLLHEIWEPNETWTGLIHSITLQLQGRKATLELQQSLQQTNDLV

SEQ ID NO: 7462 - protein, 482 aa, Acinetobacter baumannii
KTVMYKQTVQLEIISVNQTKTKIEFVISQIEQQIKNRSLTPGTRLPSVRKLAKDLGFSVSTIVEAYERLIALGKIESRSGSGFYVVAPLAPLALSELGPKLDRSIDPLWISCQSLEAEPNAFKPGCGWLPNDWMPLESIRKALRSATRSEDDSLLGYSSPLGLPALRDLLARWAQSKGIEANLNQVLLTDSGTQAIDLVCRFLLKPDDVVLIDDPCYFNFHALLKVHQVKVVGIPYTPNGPDLEAFKEAIESYNPRLYITNSGIHNPTGATLSLSTAHQLLKLIDQSNLIVIEDDIFSDFEYTPAPRLAALDNLSRVIFIGSFSKTLSASIRCGYIIAKPEWIDQITDLKIATSFSHNGLSAKILHTALTNGSYRKHLDLLKVRLAQAMQETISKLKSIGIEPWIEPKAGIFVWCRLPEGVDAAKIAQFCLNRQVILAPGNAFSQAQSAGQFIRFNITQSNHDYIYKTLAEALLQESLEKQV

SEQ ID NO: 7463 - protein, 399 aa, Acinetobacter baumannii
NASIIIFKNKEIMYMSHFQFQTVPNIISGLGSIQELQNVLASKTYRKLLLVTDAGMIKNQLHLPILQILDTLKIEHVIYADVQADPPEQVVLDAANYAKQQNVDVIVGFGGGSSLDVAKVIALLAHPNQTQNLQEMYGVNQVKTARLPLILIPTTAGTGSEVTPISIVTTGETTKMGIVSPVLYADTAILDATFTQNLPAHITAATGIDAMVHAIEAYTSKHKKNIYTDILAKHALKLLNHNLPKVLKNGNDLEARQNMLFGSMLAGQAFANSPVAAVHALAYPLGGHFHLSHGHTNALVLVEVLKFNAPYAKQYYAELMQWLDPYSNGSTDGLCDLFIDHMQNHLDRSGLTLKLSDLGIEESSLPRLAQDAMLQTRLLQNNPRDMTEAAALAIYQAIY

SEQ ID NO: 7464 - protein, 446 aa, Acinetobacter baumannii
NMSIYPKPHKTLNLSPPSLLALGFLGFITFGTLLLKLPFANTGNVSWMDALFTATSAVTITGLSVLNIHESFTLFGQTIILLLIQSGGLGFMTFAILAALSLSPKVGLKQQMMAQDSLGQTSLSKVTFVAKGVVTYTLIFELIGTVILTAAFAPTYGFARGLYYAAFYSISSFNNAGFSLFSNSLMNFQSSYIICITISILYTLGGLGFLVLMDIKQNKRWKKLTPNSKLILTTIAIINLVAFILIWALEAQNPATLGILNSGKQALNAWFQATVPRSSGFNTIDTGAMTNSSSLLMMLLMFIGGGSLSTAGGIKVGTFVILVLSVISFLRRTDEIRIFNHSVSHETTYKALAVTAITSILIFIGFFILLLLEPKADFMNLLFEVVSAACTVGLSRGITPDLHNGSLFILSLLMFAGRLGPLTLAYLIATPKKSRLKHPQANIQIG

SEQ ID NO: 7465 - protein, 180 aa, Acinetobacter baumannii
ENTMKKLALIAALSVVGIANAQAADGTITINGLVTDKTCDIVTPAGKDFTVTLPTVSKQTLAVAGDVAGRTPFQINLANCSQGKVATYFEPGATVDFNTGRLLNQDATGAKNVNVQLLGSNNNFIPVLAAGANGAQANSQWVDVAEGASADLNYYAEYYATGASTAGKVTTSVQYTIIYQ

SEQ ID NO: 7466 - protein, 483 aa, Acinetobacter baumannii
GGTMNKHLLAKITLLGAAQLFTFHTAFADIPLTPAQFAKAKTENFDKKVILSNLNKPHALLWGPDNQIWLTERATGKILRVNPESGSAKTVFQVPEIVSDADGQNGLLGFAFHPDFKHNPYIYISGTFKNPKSTDKELPNQTIIRRYTYNKTTDTFEKPIDLIAGLPSSKDHQSGRLVIGPDQKIYYTIGDQGRNQLAYLFLPNQAQHTPTQQELNSKDYHTYMGKVLRLNLDGSIPKDNPSFNGVVSHIYTLGHRNPQGLAFAPNGKLLQSEQGPNSDDEINLVLKGGNYGWPNVVGYKDDSGYAYANYSAATNKSQIKDLAQNGIKVATGVPVTKESEWTGKNFVPPLKTLYTVQDTYNYNDPTCGEMAYICWPTVAPSSAYVYTGGKKAIPGWENTLLVPSLKRGVIFRIKLDPTYSTTLDDAIPMFKSNNRYRDVIASPEGNTLYVLTDTAGNVQKDDGSVTHTLENPGSLIKFTYNGK

SEQ ID NO: 7467 - protein, 703 aa, Acinetobacter baumannii
RTYMKRSVLFISSVGVMTSHVYALEADQQAVTNLPTISVKADKESSLKQEVGQASSATKGLMQLKDVPQIVNVVPKQVLREQTVTSMQGALQNVAGLSFSVGDGQRDQVMIRGFSAITDNYVDGIRDDALYFRDMSNVERIEVLKGPASVLYGRGSAGGLVNKINKKPIDQSLREVSLIGSTTGQRRAEVDVNEKVAENVKVRLTGAVEDSDGYRDQAFLKRQAVAPSVQWDITDKTKLLLQADYLHDNRLADQGFPTDPITGKPVKTNPKTFYGALNGKEAGDVDTEISSQTISLDHEFNDNFKYHGAVRHYNYSLDRQYSVDSHPAADKSKITLTQNKRLRNEDGVYVQQELSALFNTGFLKHNTLIGAEYSKQHKDEILWQGAKTTTDLYNPKLEYWAPINTGTTVASNNNSNTFENYGLYVQDLMTVTDQLKVLVGLRYDNLSQDRDDKTSKNLDLNRTDNTYSPRIGVVYQPVNNISLYTSYNRSFQPLADSFVFYQNSDDLRPTKTENIEVGAKWDVNDQLNVTLALFEMSQTNIQNKDPNDPNGSNAILAGEQKTKGVELSLTGQLTDQLSVLAGYSYMDGKIEKSTIGFTGNHSALTPNNTANLWLKYQINDHWYAAVGGRGESSRFSAPDNKNVLPGYAVVNVALGYQSERYDVNLNLNNLFDRDYFVSGHSGANDSNMMGDPLNAQVALRYRF

SEQ ID NO: 7468 - protein, 182 aa, Acinetobacter baumannii
MAYITSSVEYAIHCLLFLVNNEDKPLSSKDLAELQGVSPSFMAKIFPKLEKAGLVVAQEGVRGGYLLARSAHEISFLDIVNAIEGEKPLFECQEVRGKCAVFNNAPPDWATSGVCAVHAVMLQAEKAMRDALGAHTLGDIADRFGRYAPDVFFSDVNGWINERIEGRTAKMRKSKISRDTPD

SEQ ID NO: 7469 - protein, 274 aa, Acinetobacter baumannii
KSHIFICFSQKYMRNIPINDVDHLPQAVLALGSDYPADTLLDTHSHRRAQFLYAPEGLMKVETEDGQWLVLPYSGVWIPAGKPHQVWLSKVSTYSLYIEVSNAPRQANYCEVIQVSPLLHQLLIQANQLPVDYQRAGRDGALIDLLLYELEAAPALPLFIPLPHNTLLSQQCAEFMERPDIHSSPKDWAHDHNKSERTFHRWFKSETGLSFQAWRNRVCIIYALNALKENISITEIAFSLGYEHSAAFTAMFSKIMGYPPTHFQKRFHAYDKTL

SEQ ID NO: 7470 - protein, 505 aa, Acinetobacter baumannii
FEHMSKFWILKSVMQKKWLILTIIVLIYLPVTIDATVMHVATPSLSAALNLTANQLLWIIDIYSLIMAGLILPMGALGDRIGFKKLLFIGTAVFGVGSLAAAFSPTAYALIASRAVLGLGAAMLIPATLSGIRNAFTEEKQRNFALGLWSTVGGGGAAFGPLVGGFVLEHFHWGAVFLINIPIILVVLVMIVMIIPKQQEKTDQPINLGQALVLVVAILSLIYSIKSAMYNFSVLTVVMFVVGISTLIHFIRSQKRATTPMIDLELFKHPVISTSIVMAVVSMIALVGFELLLSQELQFVHGFSPLQAAMFIIPFMIAISLGGPLAGICLNKWGLRRVSSLGILVSALSLWGLAQLNFSTDHFLAWTCMVFLGFSIEIALLASTAAIMSSVPPQKASAAGAIEGMAYELGAGLGVAIFGLMLSWFYSRSIILPAELPSDLIEKASISIGETMQLASNLENPLGGQLVVVAQQAFSYAHSWVLTLSAICFFLLTVFVWFSFPKKVN

SEQ ID NO: 7471 - protein, 457 aa, Acinetobacter baumannii
MNNIPHANKSFWLAHSGEYIPSPPLRGSIDVDVVIIGGGFTGLSTAYHIRKADSAASVAVLEGECVAFGASGRTSGWVVPVPVLDPTTAKVLYGKERLTELQNFAWNGLDYVQDLIKRENMDSDFEMPGVTFTTLRGHEKRLEHFTQYWQDQPRSKDSVYMDRATVSQALNSDAFSGGCRMPHSGQVNPVKHSRELKRIAEQAGAQIFEQTPVLDIEDKETFFILKTPEGEVRAKHIVLGTNGFTHLLPPELGLKRAQLPMFVYQLITEPLTDEDWKALGWKHRGQFYDKTTYCPPTCRTTVDGRLQFNLCDIYVGEGRSMDEAQKVQFYDAAERMYKKVFPAFQKLKIAQRWSGACSIPFDVRSQVGTLHNGRISYAYGYSGAGVMMSQNYGRILADLALQRKTELTEHWFVANGEKGHAKFKRFPLIPGLIAALRTYFEYERVSALSRRRRLGLD

SEQ ID NO: 7472 - protein, 462 aa, Acinetobacter baumannii
LSNIYQVLEAEMNALFMIAAAALLLGPLIAIHEFGHYWVARKLGVKVLVYSIGFGPTLLKWTSKKSGIKYQLSALPLGGYVKMLDEREGNVAEQDLPYAFNRQKPWKRIAIVAAGPLINLIFAVLLFWILFLPAQEQLNTKIGKIIPNSPAAAAQLHVGDKIIAVDGKETTTWEKLNFALIDRVGETGTVNIDVDRAGSEKNFVLPIKDFLKNQNESALDVLGFLPYRPVIPAVVTELTEDGAAIRQGMKVGDRIVAIDGQPMKDWFDVVEVVQRSPEKLLKIDVLRHEQLVHLQVMPQGKRDSMGQVNGVLGVKSDAGKITIPDEYKQTIQYTPIQAFEMALDKTGQISSMILNSIVKMVKGLIGLENLSGPITIAKVAGQSAEMGWETFISFMALMSVSLGILNLLPIPMLDGGHLVYYIIEAIRGKPVSEQIQMFGLKIGMVLLGSMMLLALFNDFMRL

SEQ ID NO: 7473 - protein, 353 aa, Acinetobacter baumannii
EKNMTTEVLGYAALSSETPLVPFKFERRTPREDDVVIQIEYCGVCHSDLHQAKNDWGFSAYPLVPGHEIVGRVTSIGPKVTKYKVGDLVGIGCMVDSCRTCSACHSGLEQYCEEGNIQTYGGVDRHDQRPTYGGYSQSITCSQDFVLKVPENLDAQAVPPLLCAGITTWSPLRHWNVGKGSKVAVFGLGGLGHMAIKLANALGAEVTLFTRSANKEQDAKQLGAHHVVLSTDENQMKSVLNQFDLIVDTVPYNHDLKPYIPTLALNGTIVLVGYLGEISANSVPMILGRKSIAGSVIGGIKETQELLDFCGEHNIVSEVEMINMQNINEAFERMLKSDVKYRFVIDMKTLSED

SEQ ID NO: 7474 - protein, 298 aa, Acinetobacter baumannii
QMNINQEQLLMFQAVMETGSFSAAARKLGKVPSAVSMSIANLEIDLNLTLFERKGREPTPTAEARVLYEKTAQLLIEMNQWKQHAHALSTGLEPNLTIVVVSELLHTNWTDYVCLLESRFPDLQINIVSAPQEDALQMLLDGSAQLALMFEREHLDNREQFVELKREALIPVISKTHPLASQEHVSYEQILGTRQIVVASRDETLKPELLFSKHYWRTDNHHSACLMILRNLGWGVLPQEMFKENPELNNKLKALDVFDFTPRFEYYVDLVWSRESELGAAARFLIDYIRNKRMQPAP

SEQ ID NO: 7475 - protein, 526 aa, Acinetobacter baumannii
KMNIRPLIGLAGAIFAAMTVEFNNRISSITLVDIRGEMGISVDSGYWVSSIYASAMIIGMILSTSWAVIFSMRRVLLFAIGLCLFSSVLIPFSPNIEIFYLLRGLQGLANGLTIPLLMACALRFLGPEIRLWGLACYALTATFFPNLSAALAAFYLDVIGWKMIFFQTIPFCALSAALVYFGIPQDPLNYSRIKTYDWTGAILAIIGLASLSTMLLHGNHLDWFHSKLICVLALMSAITLPLFLIHEWRYPTPLIKPQMLEIRNFGYAVIALFCFVVIGMSTSTLPLNYLSAVHGYKPTQTMWIGLQIAALQFIYIPIVIKVLNQAWVDSRYVHGFGLLLVMVGCLGASQLDTTWNQDQFYFWHAISCLGQTCVVLSLLMMGTNSVHPTMAIYASPMINTPRAISGVLGVCLLDWVNRVRGEYHSTRLIENTAQHVFQNIQGPVINPLTPPVLSADGTERVSGGLSALNSAIQAQQSVLVISDQYLILAGLTAILFIVMLILPVRTYPPRIALIKLMNSHNSGKSL

SEQ ID NO: 7476 - protein, 124 aa, Acinetobacter baumannii
KRNIEMEAKKPLRVLFCMGINQNFFDAEPAEAKAVWAAFGEMWNGIHDLPGVHVFGNLDDDQSMVGGSTGWPWTTYLLADVPDIETVHAACNLFRTTVVGEGPYKLWKYCKVETRVGRELIIQR

SEQ ID NO: 7477 - protein, 185 aa, Acinetobacter baumannii
SPDITCLVKLYFSTIKISFIKCDPPRYGEKSMTKKYARFLPTTESFTLEDFPYYWITQVHAQYVQNIDNALKKYGLDNSRRRIMLALSSKPHASVSELSDMIISKMSTTTKIVYRLKDEGLVETYSCQSDGRITRVYLTERGTEMINKINDLTSVVLEQSFEGITPLQLEKMMESLKLLLKNLSR

SEQ ID NO: 7478 - protein, 367 aa, Acinetobacter baumannii
LLDMGISVFNKIKDFGSELFDLVLGAEHPKVYYHPQGKIKDILDKLPQLKQKYRPTPWLTNSHVHLLYFDLIRKQTIKLAYDRIDQLTMSDGGITAIAWYGYNLPPDTPTVVIMHTITGTPESMRELVRDLNQYTGWRIALCLRRGHAGLPMPVPQISLFGSTSDLKEQLNHIQSLFPASDLYAVGSSAGTGLLVRYLGEQGEDTPFKAAFAMCPGYNTEIGFKNVHPFYSKMMTKKLFKYFIYPYQNTWSQIASLEKVLSATNLEEFEKEYFEMAGFENYETYCKSINPIYVFENIKIPLMILNAEDEGVRSIKNLEPYKEPIQQMSNVAVVTTNKGSHCAFYEGWRSTSWAARLMADYFLIEHNK

SEQ ID NO: 7479 - protein, 111 aa, Acinetobacter baumannii
KFCIIPIQRIHIKMSAVYLVVGLRAKPEKIDQVRSDLIEVVAPSRKESGCITYELFQDQNDPSLFIFYEHWASEKDQEHHHNFGPHIQNFQKEGMGNVEKIEFFHRLQALA

SEQ ID NO: 7480 - protein, 175 aa, Acinetobacter baumannii
WSCIVQNIKMKDDSCHFFTEQDITSKQVIKVCFDISDFEEIQQVYDFFGKKIYGNNREHLNDIHPNTKHFGSNLSAFHDYLRGYLIGIFSEKRNEILSITITNNSNKNVDDDWLDFFSIIMQTFFDAHKKIKYGIYMDLNFSRSIMANMMDYFSFLISDYHNRPKDELDENGNYV

SEQ ID NO: 7481 - protein, 449 aa, Acinetobacter baumannii
GVCMKNDISISEVEKSTIRKLSFRILPFLILCYFIAYIDRVNIGFAALTMNQEIGLTATAFGFGATLFFIAYVIFEIPSNMAMEKLGARIWIARIMITWGIVGCCTAFITGPISYAISRFLLGAAEAGFFPGVLLYLTLWFPKRYMARIVAVFMVAIPLSNFIGSPLSALLLGLHGLLGLSGWQVLLILEALPAILLGVLCLVWLPNTANNVKWLNQEEKDWLTSTLTFEKNQLLNSEKQDSAEQKKSKFKLLITNKYLWFFAIIYAGSSATSNILSLWMPQILKAFHLTAMQTGLLNMIPFGLAAAFMIVWGVHADKSGNKSLNTAIPLFVTSFGLLLTIFTSSLTLSLLLFSLVLMGNYAIKGPFWALVSERLPPTLVAVGIAAVNTIAHIGTGLMNSIMGIVKDYSGSFPISLLPLCMLTFTGAMIALYLGRKPTLPKVQKVQKAV

SEQ ID NO: 7482 - protein, 296 aa, Acinetobacter baumannii
ILRIVAENNMQKFMNGWVNGFIGVAIFAGSLPATRVAVTGFEPGFLTAARAVIAGVLGLILIFLLKEKKPAKQDWWPLAIVALGVVVGFPLFTALALQYMNAAHSIVFVSLLPLATAIFAVVRGGEKPNLFFWIFAILGSLVVFTYMFFLSGEASFGIGDLYMLIAIILCGFGYAEGGVLSKKIGGWQVICWALILALPIMLLATLFYMPVSFQDVSPSAVAGLVYVSLFSMLIGFFFWYKGLAQGGIAAISQLQLLQPLMGLAIAALLLHEHVSWSMLMITAVTILCVAAAKKFA

SEQ ID NO: 7483 - protein, 285 aa, Acinetobacter baumannii
KQIFSRSTKMGYVTTKDGVDIFYKDWGPRDAQVLFFHHGWPLSSDDWDTQLLFFLEQGYRVVAHDRRGHGRSSQVWDGHDMDHYADDVAEVVKHLNIKNAIHIGHSTGGGEVVRYIARHGQENVAKAVLVSAVPPLMVQTENNPEGLPKEVFDDLQNQVLTNRAQFFRDLPSGPFYGFNRPDAKPSEGIISNWWRQGMTGSAKAHYDGIVAFSQTDFTEDLKKITVPVLVLHGDDDQIVPYKTSGVKSAELLQNSQLKIYPGFSHGMLTVNHEVINADLLAFIRE

SEQ ID NO: 7484 - protein, 384 aa, Acinetobacter baumannii
LKIIRNSFMPKVHLMVRFVQVVTVLFVLLGCFVIFLYSPFYSKLIVAGLNYFVPVDVNEVAAESQRKAALSEHDNLEPGSNLWIARQAYLKLTEDALRENKTADLGYIQENYNALQQIILLEEKEQELQEEKETTAVSVPLVAKNSEIDAADEASSPIDAALSINSSENKALTEQYTEFLARKPVVPEHQKAASEPEQKVEYVRKNPLPAQPKKLSEPYAIVVLGGGLTLDKNGKDIVVNSYTRLRLEKTLEVEKKNHLPIVLSGVEAPYMQAWLKARGVDAKLLEKRSMNTCENTRFSSLLLQKKGGAPTVMLVTDEYHMPRTRRLFALNGIETIPVTAPMPTPLTRWQPSTQNYDHSRRANYELLATIRDMLFGSSDCREVP

SEQ ID NO: 7485 - protein, 212 aa, Acinetobacter baumannii
TEIIKIRVSTMADFFFNYYLMPFHLSVVALILLSVVETIGMYVGLRPSQLLKKIAPVWLTNSPLLNVKFSKALIFVFLLINFSFAGYFLQLSFFAIQHYFITPFYLIIPALVIAIFFTVFMIHCLDQVIKPKLTHTNYNLLGRLATISSGSARPGFSAQARVRDEFGQLHYVQVEPEYGELELYSQVILIKVHKSHYVAKKISVSNDLFAPD

SEQ ID NO: 7486 - protein, 271 aa, Acinetobacter baumannii
GPVMFKVWNFQRCLSIIFAILLSTNAVYAAGSDKAQSSAKINGKILVVMTNHSAYPSRSDKTGLWLTELTHFYDVALAAGYEMDFVSPLGGEVPLDERSLKSIYLDKSARQHLADPAFMQRLKTTLIPNAINPTQYKAIYYTGGHGTMWDFPNNKALQNISEQIYRQGGVVSAVCHGVGGLLPLQDENGKPLIADRTVTGFANIEETLSGIKSQVLFSLQNGLIERGAKYKEAFIPFTSYVVSDDRIITGQNPQSSKEIAEAVVKRLSSIK

SEQ ID NO: 7487 - protein, 487 aa, Acinetobacter baumannii
AISMLTNLREQWFSNVRADILSGLVVGLALIPEAIAFSIIAGVDPQIGLYASFCIAVIISFVGGRPAMISAATGAMALVMTTLVKEHGLQYLFAATILTGVIQIIVGYLKLAKLMRFVSKSVVIGFVNALAILIFMAQLPELVNVTWYVYLLVAIGLAIIYLFPYVPKLGKIFPSPLICIVIVTLLALFLGLDLRTVGDMGALPNTLPIFLIPDIPLNLDTLLIILPYSLALAAVGLLESMMTATIVDEMTDSPSNKFKECKGQGIANIASGLMGGMAGCAMIGQSMINVKSGGRTRLSTLCAGIFLLILVVFLSDWLKFIPMAALVAVMIMVSISTFEWRSLTQFKTNPKSSNTVMIATVGVVVATHNLALGVLTGVLLSALFLANKLENDIQVISSLEGNARLYDLRGQIFFSSSDKFMHGFNFKEEVKEVIIDLTHSHIWDVTSVAMLDSAVEKFQKNGIQVTVRGLNEASSIMIDKYGTHAKI

SEQ ID NO: 7488 - protein, 263 aa, Acinetobacter baumannii
MCVLTLILNTEMTMQNSEQTTSVESSLQKKKFLNTNKPLFIGAAILMSGCFALGYTIGHRQGLTVVGYDADAEQLVEVVQKQKTALDAVNKSLNAAVQERDVAVTNANDLFEALNQANADKTQQEGMSNIYREILRQRGGLSLTIQNLAIKPLPENAYEYQLDLVQVSPSKRRAAGSVEIRLIKDTEVLVVPLEDKNFNFTDFERLTGRWTMPKGFTPQFIEVRLTGGSDTPVIKRFSWQRGKPVETPSAFVAEIPQAEANSQ

SEQ ID NO: 7489 - protein, 170 aa, Acinetobacter baumannii
LKPMRLMINKSMKNIYIMGLLLACSGFAMAETATQQPTAQPVRTASNPNAIRIVTRPEIMGLWGMEIPNNKKCVEYYNFRSSNDVVIKSGEEWSYGIYEYQPSDDPKEQLSALVMQIKFDNNKVDCSGQKQDQTGDISQYFVQWKNDHTINFCSTAKGEQCFATLRRMLP

SEQ ID NO: 7490 - protein, 155 aa, Acinetobacter baumannii
ETAMTILMILLAVIGGALLSVQAAINGQLGAKVGVFRSAFLTFSVGALITALLIFYFEPKQALTLLDVPKWQLLGAMCGVPYIVIMVLAVQRIGAAVATVAVIFGQLLMSILIDNFGWFGNETLPFSLYRLGALICLGIALYFIYSSSKDKKVEG

SEQ ID NO: 7491 - protein, 422 aa, Acinetobacter baumannii
SKAILNEVIPMKVFEKLVFPNGSYVPNRIAKAAMEENMADLNHAPSEELMRLYQAWANGGVGLIITGNVMVDRRAMTGPGGVVLEDEKHLDTFKKWAQIGRSKGAQMWLQINHPGRQMQANLGQQTWAPSAISLDLGKMSNRFNTPIEMTESMIAEVIQRFANTARLGEKAGFTGVEIHAAHGYLLSQFLSPLSNKRQDQWGGSLENRARILIEIVEAVRKVVSPQFTVAVKLNSADFQRGGFSAEDAQQVVKMLNEHAVDLVELSGGSYEAPAMQGQARDGRTLAREAYFLEFAQEIRKVAKMPVMVTGGIRRKQVAEKVIESGVDMVGIATALAIEPNLPNAWKQGHNVTLGLKPITWKNKTLASLANMAVVKFQLRNLSAGKKTKPNVSPAWALILQQSAMSCRTRQYKKGMRDYSFAS

SEQ ID NO: 7492 - protein, 761 aa, Acinetobacter baumannii
GGHMLSRQLEVSLRLAVSMARQKRHEFLTVEHLLLALLDNDSAVNALKACGADIVSLRKELEEYVEQHTPKLGENSEQAPHPTESFDRILQRAIFHVQSSGGDRTVEGADVLVAMYSERDSFAVYLLKRHQINRLTLTQYLSHGTRKDEVQVEEEVEDIEGESNSGNAGPLELYTLNLNVEAQKGKTDPLIGREKEIERTAQILCRRRKNNPLLVGDPGVGKTSIAEGLAWLIVNGKAPKPLSHAEIYSLDIGALVAGTKYRGDFEKRLKQLLNALKKNPNAILFIDEIHMIIGAGSSMGSTMDASNLIKPALANGTLRCIGSTTFQEYRQVFEKDHALSRRFQKIDVNEPSISETIDILRGLKTKFEDFHHVQYDDKALVSAVELSAKFINDRFLPDKAIDVIDEAGAQRRLKAESEDSLITVENIEDIVSKIARIPPKTVSKDDKSVLENLERDLKRVVFGQDEAITALASAIKLSRAGLKSPDKPVGSFVFAGPTGVGKTEVTKQLAKLLGVELVRFDMSEYMERHAVSRLIGAPPGYVGYDQGGLLTDAIHKNPHCVLLLDEIEKAHPDVFNLLLQIMDHGALTDNNGRKSDFRNVIIVLTTNIGAESISRASIGFTEQDHSSDNQEAMKRAFSPEFRNRLDGVIQFKALPTTVIESVVDKFLTELQAQLDEKRVVLDVDQSARDWLATNGYDRLMGARPMQRLIQEHLKKPLAEMILFGELADHGGNVAVSVKKEDGKAVGLKLEVFEDHHTAEPA

SEQ ID NO: 7493 - protein, 65 aa, Acinetobacter baumannii
NKNIKQLPSPIATHDISLDINLSSLKKNGKTHLLMSISLNQDKYQGNVNANIKELTKIATDRGLL

SEQ ID NO: 7494 - protein, 281 aa, Acinetobacter baumannii
KQCIKTINYKKNNIKLILSKQLYSIWIYSKKLYNIDTYFLMLLINLLTNKIGKIVMYKFLALSFISIGLVACNKTSEDSALTINNQEYMPKHQLTANKYIYEYNNIIYNLPNNSDQKSINLKLKKLLNTMPSNEDNLAILKTKRKILIRLGCLEQAYAITEKMLTKANNSKLQETQCIFLKRMKKDISLIKQCYEKTASSYLNEINLIPKAQLWYQYALWGNYAAMYHAGHKEYKLKLLELINYHNNEDHRLTYRQMYESVVNPSILQKRIDRIPYSPECR

SEQ ID NO: 7495 - protein, 60 aa, Acinetobacter baumannii
TVSMLANIKTAVAIIERFDSLLIPQMPCPLVQPDPSRVPKPTSIPARISTNELALISISG

SEQ ID NO: 7496 - protein, 61 aa, Acinetobacter baumannii
FLLIVAERVHQIRLIYCKFCGELAMLKNDKISSNLTELILNRIDKNSSCILCNGGISIFNR

SEQ ID NO: 7497 - protein, 303 aa, Acinetobacter baumannii
DILMLTDLDDFYCFALVVEHGGFSAAERVTDIPKSKLSRRVYNLEENLGVRLIQRSSRHFAVTDIGMDIYRHAQVMMNAAQAAHDLVDHLSIQPRGVVKVSVPVDIAQNQLPKILPAFLKKYPEIRLQLIVSNRRVDVINEGIDIALRVRSKLDDDPSLVLRQFALIEQSLFASQAYLNEFGNIKSPDELSDHRILSLSEEHLDQQFILHGPDNQLKKVKVSPTIMGTNIYMLAQLASQNCGIALLPDTAAEDFVKSGQLVQILPDWKAAHGIFHAVYPSRRGLLPAVRVFIDYLVEHLSEHP

SEQ ID NO: 7498 - protein, 865 aa, Acinetobacter baumannii
LYLMTLCVCKRIWIYNLLEKTGMRHTHFLMPLALVSAMAAVQQAYAADDFVVRDIHVNGLVRLTPANVYTMLPINSGDRVNEPMIAEAIRTLYATGLFDDLKASKENDTLVFNVIERPIISKLEFKGNKLIPKEALEQGLKKMGIAEGEVFKKSALQTIETELEQQYTQQGRYDADVTVDTVARPNNRVELKINFNEGTPAKVFDINVIGNTVFKDSEIKQAFAVKESGWASVVTRNDRYAREKMAASLEALRAMYLNKGYINFNINNSQLNISEDKKHIFIEVAVDEGSQFKFGQTKFLGDALYKPEELQALKIYKDGDTYSQEKVNAVKQLLLRKYGNAGYYFADVNIVPQINNETGVVDLNYYVNPGQQVTVRRINFTGNSKTSDEVLRREMRQMEGALASNEKIDLSKVRLERTGFFKTVDIKPARIPNSPDQVDLNVNVEEQHSGTTTLAVGYSQSGGITFQAGLSQTNFMGTGNRVAIDLSRSETQDYYNLSVTDPYFTIDGVSRGYNVYYRKTKLNDDYNVNNYVTDSFGGSLSFGYPIDENQSLSASVGVDNTKVTTGPYVSTYVRDYLLANGGKATGKSSWCPSGKNKTDPNTQQPIPDTCEGGFEDYNSAFEGEFFTYNLNLGWSYNTLNRPIFPTSGMSHRVGLEIGLPGSDVDYQKVTYDTQAFFPIGSTGFVLRGYGKLGYGNDLPFYKNFYAGGYGSVRGYDNSTLGPKYASVNLQETKQNDGSPEEVGGNALVQFGTELVLPMPFKGDWTRQVRPVLFAEGGQVFDTKCNIDNSVYGNKGMKINGQTITDVRKYCEDNYGFDLGNLRYSVGVGVTWITMIGPLSLSYAFPLNDKPGDETKEIQFEIGRTF

SEQ ID NO: 7499 - protein, 221 aa, Acinetobacter baumannii
LYLIKVKKMTSENIRDPKQDHLLTPENSAFIVIDYQPVQVNSIASMDRQLLINNIVGTAKAALVYNLPIIHSTVNVKTGLNKPPIPQLSKVLKDYPTYDRTSINSWEDTEFKEAVKATGRRKLIMTALWTEACLTFPALDALAEGYEVYVVVDAVGGTSVAAHEAALRRIEQAGGKMISVAQLFCELQRDWKRSETVPQFMKLFIETGGTAGIQFSYDKAE

SEQ ID NO: 7500 - protein, 257 aa, Acinetobacter baumannii
LSLILIKCNMNKLYKNESPEMILAFENAIGTFKYFWRELYWESRRIVPALELAYVKCAFIQENLEDKNEPLIEYMWIDQVDFDGSTISGILLNEPYIIENVQAGETVRLQFESIVDWMFLSNGTVHGAFTIQEYRKTLNASGRKEYDEAWGIDFGNPDEILLVYDQKNCPENLEEHPMCRSILEQFINIINTDPTIITEKDESGNQLLHREVIADNYLFVQELLRLNVNKLVRNKQLMIPLDLAHKMGWSNIVNLLK

SEQ ID NO: 7501 - protein, 217 aa, Acinetobacter baumannii
FDLIGSTSMNNWNFQELKETPSQTGGPYVHIGLLPQQAGIEVFENNFNNQLVQDQTKGERIRLEGQVFDGLGLPLRDVLIEIWQADANGIYPSQADTREQKADPAFQGWGRTGADFETGVWSFNTIKPGATAGRKGSTQAPHIALVIFARGINLGLHTRVYFEDEAEANANDPILNSIEWAPRRQTLIAKRFEENGEVVYRFDIRIQGDDETVFFDI

SEQ ID NO: 7502 - protein, 359 aa, Acinetobacter baumannii
NKLMKVQQYRLDELAHLVKGELIGEGSLQFSNLASLENAEVNHLTFVNGEKHLDQAKVSRAGAYIVTAALKEHLPDKDNFIIVDNPYLAFAILTHVFDKKISSTGIESTAQIHPSAVISETAYIGHYVVIGENCVVGDNTVIQSHTKLDDNVEVGKDCFIDSHVTITGGSKLRDRVRIHSSTVIGGEGFGFAPYQGKWHRIAQLGSVLIGNDVRIGSNCSIDRGALDNTILEDGVIIDNLVQIAHNVHIGSNTAIAAKCGIAGSTKIGKNCILAGACGVAGHLSIADNVTLTGMSMVTKNISEAGTYSSGTGLFENNHWKKTIVRLRQLADVPLTQITKRLDHIQAQIESLESTFNLRK

SEQ ID NO: 7503 - protein, 121 aa, Acinetobacter baumannii
FMLIDSLSITRIFSVFGLFIITAIAEILGCYFPYLILKEGKSAWLWLPTALSLAVFVWLLTLHPAASGRIYAAYGGIYIFTALMWLRFVDQVALTRWDILGGVIVLCGAGLIILQPQGLIR

SEQ ID NO: 7504 - protein, 589 aa, Acinetobacter baumannii
LILIVILYREICMNNKQVLRSAAWFGTTDKNGFMYRSWMKNQGIPDHEFQGKPIIGICNTWSELTPCNAHFRKIAEHVKKGILEAGGYPVEFPVFSNGESNLRPTAMFTRNLASMDVEEAIRGNPIDGVVLLTGCDKTTPALLMGAASCDIPAIVVTGGPMLNGKHKGKDIGAGTIVWQMHEELKAGKIDLNEFLSAESGMSRSAGTCNTMGTASTMACMAEALGTSLPHNAAIPAVDSRRYVLAHLSGMRIVDMVHQDLRLSKILTKEAFENAIKVNAAIGGSTNAVIHLKAIAGRIGVDLQLDDWNRVGRGMPTIVDLQPSGRFLMEEFYYSGGLPAVIRRMGEASLLPHPQALTVNGQTIWENCQQSPIYNDEVIRKIDNPIRQDGGMCILRGNLAPKGAVLKPSAATPELMKHRGRAVVFENFDDYKSRINDPDLDVDETCILVMKNAGPKGYPGMAEVGNMGLPPKILAKGITDMVRISDARMSGTAYGTVVLHVAPEAMAGGPLAVVQNGDFIELDAYAGKLHLEVSDEELKQRLENLAPPAPPSFIGGYRKLYVEHVLQADEGCDFDFLVGCRGSEVPRHSH

SEQ ID NO: 7505 - protein, 455 aa, Acinetobacter baumannii
ESLIMSQLYASLFYQKDVTEIFSDSSLVTYMIQVEVALAQAQAQVGVIPQNAANTIAQVAEHALDKFDFSALAVATGLAGNIAIPFVKQLTAIVKDIDEDASRYVHWGATSQDILDTACILQCRDALNMVEGQLQQCYATALQQAKQYRHQVMIGRTWLQQALPITLGHKLARWASAFKRDLDRIQAMKSRVLTAQLGGAVGSLASLQDQGSLVVSAFAKQLNLTVPTSTWHGERDRIVEIASVLGMIVGNTGKMARDWSLMMQTEIAELFEPTAKGRGGSSTMPHKRNPVAAASVLAAANRVPALMSSIYQSMVQEHERSLGAWHAEWLAVPEIFQLCAGALSRTGEVLQGFEVNAEHMQQNLECTNGLIMAEAVMMALAPKIGRLNAHHLVEAACKTAVAQNEHLFDVVSQLDEIKGQFSQEEIRNIFKPENYLGNIQQQIDAVLKEAQGESK

SEQ ID NO: 7506 - protein, 156 aa, Acinetobacter baumannii
RLLMILYVCSYVLRKPFFSEKRVDLKEIGWEKLSNIVKKVFSCGGSIIIHKTDADYSEESERLVYSDINSYSMVCDSRYGYLFGCSISENEEYPAGTYLRLVNRKTKNPDEIYIFEPHEDEWKAKYVNQDLELALNLFKDIYEYGDLLEDSNIMLE

SEQ ID NO: 7507 - protein, 63 aa, Acinetobacter baumannii
VELIEKNMKDIEILEINEMGDYEKDLSLLLEDSINSGASIGFLAPVEKNEVLNYWSEVNHKLA

SEQ ID NO: 7508 - protein, 68 aa, Acinetobacter baumannii
AAIIVKMPTLSCFYIIFLIAFVLAVFKLIMKHSRLVKDFLNALYLFNRYSNDMCNLMITQVISLLNFC

SEQ ID NO: 7509 - protein, 348 aa, Acinetobacter baumannii
ILIINFTLTLLSKNLTLNSIGIFMKKIGIVAVSAVTLCWAMYEVSSDNTNTVPRNESNQKVASKSISSTTKNEKLASQTLLAQTTSLNSSAPVCKYNFDATQEDYDLWNNEHTDYWPIKIFPLIIGQKFGFKVEPTPESQYGYVDYVATSKVDSLNSVNEIGDLIIPHTGIIAFEMELKIPTSTLGSSSLGNSTYYSSSIGFSGVTNNGYTIRSNYWFDMGGYDPDFGENPARLNYYVAYRLSDNSGPNNPYYKGQNMTNNSNEYQRLGMYINQNTKQVGFILNGVDQGYQSTLPAPLENIRFSVSSSIGIYSNQLFGQELSNELITDRNALQFNYPQGTTDMCGNAI

SEQ ID NO: 7510 - protein, 467 aa, Acinetobacter baumannii
EIIIMTDQYQAFTQSPIGKFVVKNLGLPSPVVLERFESAQPVVKGAVLVGAAPSSVLSGAIAQVLSNIHADSYVGNNVALQQEAAKVGLNLRPFNAGDKESKFKAVVFDASGIQNSEQLNELYKFFNPIARQVATSGRVIVIGTTPETAKTVKQAIAQRALEGFIKSVGKEFKKGITAQVVYVDEGAAANLESTLRFLLSPRSAYVSGQVIRVSKAVVVDVDWAKPLAGKTALVTGASRGIGEAIAHVLARDGAHVICLDVPQQQADLDRVAADIGGSTLAIDITAADAGEKIKTAAAKQGGLDIIVHNAGITRDKTLANMKPELWDLVININLSAAERVNDYLLENDGLNANGRIVCVSSISGIAGNLGQTNYAASKAGVIGLVKFTAPILKNGITINAVAPGFIETQMTAAIPFAIREAGRRMNSMQQGGLPVDVAETIAWFASTASTGVNGNVVRVCGQSLLGA

SEQ ID NO: 7511 - protein, 254 aa, Acinetobacter baumannii
TSIILLNSLRILRYIKMWLKLSTLFLLPVLFIQGHKVRKNKPRLAEAKGEREGRAGQGKSLSLLIFGDSAAAGVGVENQKDALSGAIIQELQNEFSLQWKLHAKTGDTTRQVFNALQHLEEQKYDVIVTSIGVNDVTKLTSAKSWIKQQKQLFEHIQKRFQPKLIIVSGVPPMQHFPALPNPLAWLFGQYAEQMNQKLQQWLAPQSHFKFLEYDIETFQAMNLPMASDGFHPSKEVYAVWGRQVAALVRQSFNS

SEQ ID NO: 7512 - protein, 449 aa, Acinetobacter baumannii
FCVIQKTKHIYVYIFIKEDNMTALMLMALAVSIGLGYKTKINIGFFTIAFAYLIGCFGMGLKPSEVIELWPVKIFFIILSVTLFYNFALANGALEKLASHLLYKCRKFPQFLPLAIFFAATIIAGLGAGFYTVLAFMAPITLLLCKKTNMNMIIGGMAANYGALAGANFMTSQSGIIFRSLMENTGISSQTAFSYSSGIFVLTLIIPIAVLGIYTLWNRKSNSIVIEDQKPEPFDKKQKQSIFLIILMMSIVLVFPILHLVFPDVKTISFLNSKIDIAFLAITFSLISLLMKLADEKKVIALVPWGTLIMICGVGMLIALGVKLGIITTLSEWLANNVPVWVIPVLLCLISAIMSVFSSTLGVVAPTLFPIVPALALTSGLNPLVLFICIVVGAQSTAISPFSSGGSLIMASAPADIDKTKFFNQLLFKAIPVGVIAALIAIFALKFVM

SEQ ID NO: 7513 - protein, 112 aa, Acinetobacter baumannii
THPIFRSCLILVDKGVILMTQSTLYLLQASYHHTPRIIEELAKLFHKDDQIVFMGDSTAQLSVNICQQFGSVSCLSHEKDLIDAETLAQVKVLNYDQFADLVLQFNRCISLK

SEQ ID NO: 7514 - protein, 473 aa, Acinetobacter baumannii
CHVLISTLPMSHASSCFQQNQFFVLVEYLTSLHEIYPVRHEFAGYPAAMTLADRVHSDHDIAPLEASKSYPDSIEKVLHFSGKARDIQDFEQFLEQAQTANIQNLLLLTGDKLKEHHNGRDGQPRSRYLESVNAVMAAKQHGGFRIGVAFNPFKYVEAERDAQYLKLHKKIKAGADFIITQLGYDIEALKQAKAFLTKNNYSQQILACVMPLTLGRANFMVKHKVAGIVITPHMLKVLADEKQAGHTDRVYLRCALQILICKHLGFSGIHLSACHKPEEQMLLESYVEQYRHLELNVLEELWNSLWQVTTSKEFTPEIARFSRQPTSKQIIKYRQLHVMHEALFGSKIAKGVGRFIFKASFWENALIAKLLLKTEVLSKHSLVGCESCGQCRLGDTLYICPETCPKGLANGPCGGTTLDRCEFGDRECIHSVKARLAKAVEQTEILKEKLILTVPLETRGTSSWKNWYLATEA

SEQ ID NO: 7515 - protein, 826 aa, Acinetobacter baumannii
LAQMLELFGFSICGVGSMSESDSKFHILFKIWCFILGLALLATGIFYIVGGGKLVSLGGSWYFLISGLFITISAISIFRKKALGVWIFAAVFVGTVIWSLIDAGWEFWPLFSRLMFPAGLFAALLFTLPSIRRYQFQTSLASSSYAIGGLVVVGILIALYQMFQPHPTVASSGEKLPLVPVDPAKKQVNWENYGNDAGGSRFVALDQINRDNVHKLKEAWRFRTGDFTTGSGNGAEDQMTPLQVGNKVLLCTPHNNIFAIDADSGKQIWKAEVNSKADAWERCRGVAYFDSTKPLVQPTLAGATPVTTVANNTACPRRVYTNTPDGRLIAVNADNGQRCADFGVNGTVDLLEGLGGGTKAPRFEVTSAPTIAGTTIVVGSRIADNVAADMPGGVIRGYDVITGKLRWAFDPRNPDPNYVLKPGEIYKRSSANSWAAMSYDPQMNTVFLPMGSSSVDIWGGNRNPLDHKYNTSVLALDATTGKEKWVYQTVHNDLWDFDLPMQPSLVDFPLKDGTTKPAVVIGTKSGQFFVLDRVTGKPLTKVIEQPVKAANIPGEQYSLTQPRSVEMPQIGNQTLTESDMWGATPFDQLMCRINFKSMRYEGLFTAPGTDVSLSFPGSLGGMNWGSIAFDPTHRYMFVNDMRLGLWVQLIKQTPEDIKIQASGGEKVNTGMGAVPMKGTPYKVNKNRFMSALSIPCQKPPFGTMTAIDMKTRQVAWQVPLGTVEDTGPLGIKMGLKAPIGMPTIGGPMATQGGLVFFAATQDYYLRAFDSSTGKELWKSRMPVGSQGTPISYVSPKTGKQYVVVTAGGARQSPDHGDYVIAYSLEK

SEQ ID NO: 7516 - protein, 333 aa, Acinetobacter baumannii
NMQIIQFENRANQRAVAKVEGNMAYPVKDIQSVRDLALLAIRNKVSLEQQVEALGFESETYDYSSLLADLKVLPPLDHPDSTHCLISGTGLTHLGSASARDKMHQQNLSDDNSVTDTMRIFQWGLQKGRPAEGQIGAQPEWFYKGDGSIVVRPGAELPLPPFAEDGGEEPEIAGLYVIGEDLKPYRIGFALGNEYSDHVMERRNYLYLAHSKLRFCSFGPALRTGELPKHLVGTSRLRRDGQIIWEKEFLSGEDNMCHSLANLEYHHFKYRQFLKAGDVHIHYFGTATLSFADGIQAQVNDEFEIEMKEFGHPLKNKLAHMQPELPIGSVITL

SEQ ID NO: 7517 - protein, 144 aa, Acinetobacter baumannii
GLKMKKIIKILLLSSLILSIPLSVVAKNVETKVSFLKGSSQTTLTGKFQGYDDVRYRVFAKSGQILKFNINSYGNLAYINIFAPGQKPGKDKPLFVGSTVGFSGEVTLPVDGDYIVQVYQMKKSAQRNRAVSFNLDLQILDNKK

SEQ ID NO: 7518 - protein, 149 aa, Acinetobacter baumannii
EQKMTQNKVELAEKLSKESHQGQKYGPHDYFDYHIKGVVNSLIEHRFSEVYIITALLHDSVEDTPLTLAKIESLFGKEVRDAVDALTKRETETREEYLIRCSSNPIARVVKLHDAAFNAHNSHKESNQSRVDYYLQTMLIVSTAQDRLG

SEQ ID NO: 7519 - protein, 264 aa, Acinetobacter baumannii
MRKILGIASLIMSTGVVHAEQLNEQEQISPYSANVTFASQYISRGFQQTWGKPTLQIGFDYANPNGLFVGTWASNVSSNYLRDASVEWDFYAGYLKTIDKFSIGMSVFYYYYPGAKSTAETGSTSYNYGEIVPQISYGPLSLKYFITYTPDYAGYNSNTMGGPEGKRSRGTTYLDLNFTQPINESWTFGAHYGYERIKNFSEANFQDMKVELIKDLGDGWTTGLAYTKAWDKDGYYRNYSNGEPDAPISNPIDSTFTVSVKKVF

SEQ ID NO: 7520 - protein, 98 aa, Acinetobacter baumannii
AMKIGFIGGANDGIVINAANGIDTYKLEWHYKAEKHCEEQPSLGLNGPEYDYYNLLILRKNKEAKLFYVLTTMGKEDIADKINEYWEYSTSVGYDFDE

SEQ ID NO: 7521 - protein, 152 aa, Acinetobacter baumannii
NSKMNVDAIDLKILKYLQDNARLSNQELADLVNLSASACHRRVKILETNGIIEKYQAKVNYEKLGIKIEAIVEIKLAQLTENDHNFFLSQIKNFDEVINAYIITGESNYVLHVATKDLNSFSHFVINTLNKIKGVVSINSKIILQKIIQKPL

SEQ ID NO: 7522 - protein, 233 aa, Acinetobacter baumannii
GEKMSKRILHVVTNVSRYKNVDEPTGLWLGELTHAYDEFEKQGYVQDIVSPNGGKTPIEPKSLVPLVADKSVKDREKDQAFITLLANTFKPSDINWEDYDVIYYTGGHGVMWDFLDNPELQEITKNIYEKGGIVSSVCHGYCGLLNVRLSNGERLIKGKKLTGFAWSEEVLAGVAKKVPYNAEELAKEYGARYEKAFIPFAPYVVQDGKLITGQNPFSAKKTALAIIEELEKS

SEQ ID NO: 7523 - protein, 367 aa, Acinetobacter baumannii
LRKIFMSTLEAQDHSMTESPKLTKMQYLKKHWVMVIAFIIVLVSILWILKVIFLPSSVVKTDDARVDVEYSTIAPKVSGNIEEIYIKDHQTVKKGQLLARIDARDYQAALAEAESNYAKAQADLNEAMLAVERQPTVIRETEAQLRKVEAGIKLTKDNTARYEQLQALGAESRLITQQSKTTLTEQYADLDSSKEKVIDAQYQLNQYKIQVQAKQAALKQAQAALDKAKLNLSYTEIRAPIDGMIGQKSANVGNFVGAGNPLMVVVPLDQVYVEANFREIELKQIKIGQPVTVYVDAYNVELKGVVDSFSPSTGAFFSPISATNATGNFTKIVQRLPLRIKLLENQPDIKLLRPGLSVVVSVDTTKK

SEQ ID NO: 7524 - protein, 446 aa, Acinetobacter baumannii
GDEIMKDISHREVYALVDINNCYVSCERLFNPKLNDKPVVVLSNNDGCVVSRSEEAKLLGIKMGVPWFQIEKDALQAGVQVYSSNYTLYAEMSRRFFAVLGEFFSPDDLEAYSIDECFIHLTPYLQSIDISDYCNKVRNTLLKWLGLPCCIGIGYSKTQAKLANHYAKKIKSFKGVCNFITLDPLIMEDLMQQTSVKEVWGIGYQLVKQLQSYEVYTCLDLTFANEHHMAKAFSVVMARTIRELKGQSCIQLDDPAIPTKRILASRSFAQALSSIEIIKQALIFHLNRAHRRLMKQEQLCACVQVMLYEKTDKPPYKKVTSQAIGLHYATDDLCILTKAAMQQIDVLYKENKSYIKIGVLFCALHARQQHIDDLWQPLELIHQRQQLMETLGTVRKRFGNHYLQVGYHSRNPSWQMKQCHRSKNYLTRWNEMLTIEDAYTPVTQNT

SEQ ID NO: 7525 - protein, 70 aa, Acinetobacter baumannii
VQEITFLGFKAIFAEELINRNKNLPKKAEKGCNSFKNLYTLFCNGSPAGGFAIVLCEPRQDRKVATVADL

SEQ ID NO: 7526 - protein, 294 aa, Acinetobacter baumannii
IKEIKAMQQPLLKDFFDENTNTFSYVVADLATRQCAIIDSVLDYDAASATTKTTNADLIVDYVLAQNFKVQWILETHVHADHMTAAQYLKSKLGGTIAISQKISVVQETFSAIYNFDFKKFNENQPFDYLFEDYEHFKIGEIDAYNIPTPGHTPACLSYVIADAVFVGDTLFMPDYGSARCDFPKGSAAALYDSVQKLYTLPDDMRMFLCHDYKPGGRDEYICQTDIKTQKQSNIHLNRRVSKESFIKMRQERDATLAMPKLILPSIQINMNGGNFPEPEANGIRYLKIPFNYF

SEQ ID NO: 7527 - protein, 164 aa, Acinetobacter baumannii
CHLIIIGDVMRFLVLATLSGLALMGCASVQQAPNTQETIRYASSPCFGACPIYSVEVTPTGLIRFEGKQYTKAIGVKEIQGSVKDYQKLADELKTYRPQTGTQSKTAGCQQTATDMPSYYITWIQPNGTETKLSHYTGCISPANNRLNKVMEKLPEQLGIKDLI

SEQ ID NO: 7528 - protein, 154 aa, Acinetobacter baumannii
IKLIERIMMSKLREDDAVETMRVDKWLWAARFFKTRSIAKAAIEGGKVHHNNERVKVSKEIRVGMELVVQQGFDKKTVVVKALSNTRGPAPVAQQLYEETEVSIARRELIASQRKLHNLARPDHRPSKKDRRQINRFKQDNDRHYEDHWSYNDE

SEQ ID NO: 7529 - protein, 575 aa, Acinetobacter baumannii
VNLMQTAKHLLFVTNDPQQQVNTLILARKLALVATQHGYKHSVISLDEFESSDHFDHVIIIGQQPKNLNIFGQNALSLVSIEDIKDDADKALLTALEHSKPANEWEQKPKQASNTATHFVAITACPTGVAHTFMAAEALQQGAERLGYQIDVETQGSVGAKNILSPQAITDADIVILATDIEVNTDRFVGKRVYRCSTGFALKQTDKAFAEAIANAQVLEQGKQQAPTENKDKTEKVGVYKHLLTGVSYMLPMVVAGGLLIALSLCFGLNAAEQAGSLPAILKQIGAAAFTLMVPMLSGYIAYSIADRPGLAPGLIGGLLAAQLQAGFLGGIVSGFLAGYIALFIAKKVKLPTSLESLKPILIIPLLGTLSVGLIMFYVVGQPVAHIFELMKDFLNNMGTTNAVLMGIILASMMCIDLGGPINKAAYAFTVGLLTTNTYMPMAATMAGGMVPAIGMAIATFLARNKFSTGEKDAGKAAFVLGLCFISEGAIPFAAKDPMRVIPTCILGGAVTGALVALFHCELVTPHGGVFVLLIPNAINHAWLYLAAIAAGSIVTGVSYAIIKKNQEEKLLTNS

SEQ ID NO: 7530 - protein, 275 aa, Acinetobacter baumannii
SIMINTTYKLISKLNLKNATYGQYFEKEQIDTERLKVMYSIYEQYYENTRFSIFVDDFKNKSGAILIFDSETDEIVGFSTVVVQHFYLNGKDYTVLFSGDTVILKKFWGTRTLQSTMLKLMIKLRIKYPFNELYWLLISKGYKTYLLLANNYYVYYPNIKDENQHLSEVVEHYCEKFFGEYYDKEAGLLNFGDDYQPLKGEVAPITAEMREKNPNIHFFEQKNPTWRAGTELPCIGRLGWKDIARFPVKLMTKPTSKGKFEAQLSHKTKRREAIQ

SEQ ID NO: 7531 - protein, 346 aa, Acinetobacter baumannii
VQMMKQYHSETAPSLLQDQYGRIKRKLRISVTDRCNFKCVYCMPEHPEWLNKQDLLSFEALFQFCHFMVQQGIESIRITGGEPLMRQGIVHFIRDLQSLKSLGLKRISMTTNGHYLAKHAKQLKDAGLDDLNISLDSLDPVQFKELTKKKLEPVLEGIQAAKEVGLPFKINCVLMKDRNDDQILPMVKWSIAHHIPLRFIEFMPLDGDALWSNKDVVSEAEILQVLQPYYSVQVIEQQHEPARQYLINGSYHLGIISTITHSFCHQCDRIRLTAKGELYNCLFAPQGLNIKPQLQTLVSKQHTPEYGVYIQNLKNLVHPYIWHKAKGFHALQHQQTRKISMHMLGG

SEQ ID NO: 7532 - protein, 388 aa, Acinetobacter baumannii
KLEMNMAFRQFERTSLQLSMGTLLSCLCASVAYADTLAPVKPASVDACVALASNADRLACYDAVFKPSALPVVQAAVVPEPVKKIDKPVVQPETFKEKVVDKVSNIKVIGKAPTLEPTTSLLDQRWELSEKSKLGVWNIRAYQPVYLLPVFWTSDKNEFPSSPNPNNTVTEAQNLKSTESKFQISLKTKAWENIFGNNGDLWVGYTQSSRWQTFNAEESRPFRETNYEPEASLMFRTNYELLGLDGRLLGVTLNHQSNGRSDPLSRSWNRVIFNVGLERGNFALMLRPWIRLEEDSKDDNNPDMEDYIGRGDLTAFYKWKQNDFSLMLRHSLKGGDDSHGAVQFDWAFPISGKLRGHFQLFNGYGESLIDYNHRATYAGLGVSLMNWY

SEQ ID NO: 7533 - protein, 397 aa, Acinetobacter baumannii
YMEIVMNIRQVSAICLSIAATHFVYAASNVTNPVNDFSQAKGIIKNQYIVILNKDAGPSKDFAQNIAKQHAGKVLQSYDTVLKGFAIYLPDTAGAAFIEAMKKNPHVLSVESDTIVNIDATTQSNPDWGLDRIDQKALPLNSAYSYLQTGSGTTAYIVDTGILSSHQEFSGRVLSGYTAISDGNGTTDCNGHGTHVAGTVGGTTYGVAKNVNLVPIRILGCDGSGASSNVIAGLDWILKNGKKPAVVNMSLGGATSSSLDSAVENLYNNGYVMVVAAGNSNTDACTSSPARVSKAITVAATDNTDTRASYSNYGSCVDIFAPGSQINSSWIGNNTATKILNGTSMATPHVAGVVAEMLQSTPTASPQTISTNLLNQASSNVVKNPSGSPNRLLYKSP

SEQ ID NO: 7534 - protein, 774 aa, Acinetobacter baumannii
MKRMKPMRKQRLLNDIQKILALNLSIAASFWGLNTQAFAHGGKADMVSLYQNMSEQGAKVVKDDFTNTYTITKGSIVVRAKPNSNQVLVNGKPLKLSVPLLIKDGKPVIGKDFFNEVFQSGLDQTFKVENTFHPLNSLNSDEIKKTFDVINRSKYAYKNMRFAELKLKEPEKAKVWDYFINHKDFKEDRIASFILLKGNQAIEGEVNLNTQQVTKWNVLKDTHGMVLLDNFEAVQRVIETSKEYQDALRKRGITDVKKVIATPLTVGYFGGKDGLDKQLNILKVVAYLDVGDGNYWAHPIENLVAVVDLDKEKIIKIEEGAIIPVPMANRPYISNKPVASKLKPLNITEPEGKNFSITGQTIHWGNWCLHVALDSRVGLQLSTVTYKDKGVKRKVMYEGNLGGMVVPYGDPDIGWYFKSYLDSGEYGMGTLTSSIIPGTDAPDNAVLLDAVIADYKGQPQVIPNAIAVFERYAGPEYKHHEIFGNQDASEARRELVVRWISTVGNYDYMFDWVFSQNGVIGINAGATGIEAVKGVKARTMHDSTAKEDTKYGTLIDHNIVGTTHQHIYNFRLDMDVDGENNSFMHMDPVVKANDKGGVRTSSMQIDSKVITNEQNAAEKFDPSTIRLLTNFNKENKLGNPVSYQLIPFAGGTHPVAKGANFSKDEWLFKRLNFMDKQIWVTQYNPDERYPEGKYSNRSTHDTGLGQFIGNNENIENKDLVVWMTTGTTHVARAEEWPIMPTEWVYTLIKPWNFFDNTPTLNLGEEEQSTQHDHH

SEQ ID NO: 7535 - protein, 72 aa, Acinetobacter baumannii
TEVLVFVAFGAAATFEDVDGVAEAALLLRGLRAGAVVERVRVVFGVLVAALGVVLLRLAVLEADFDVFDTFS

SEQ ID NO: 7536 - protein, 838 aa, Acinetobacter baumannii
IAHFYIIMKVRISKLNISMLNSRPHPTRPLIKYGTLLLGALLAGCNSSSSLDPTPTQKQITIKRDKFGTPHVYANDTYGLFYGYGYSVATDRLFQMEMSKRTGQGTVAEVLGPDYLQYDIATHSRFDPENIKQQLAALSPEDRAIFEGYAAGFNKRVKEVLADPALMPKEFTDHGFKPSTWQPEDIAMVWVGLILNRFFSASSEVSNLDLLTQLQKEKGQEEGLKVYQQLRWLDDPSAPTIIQSAQKTQLLAHQQQILKDISPISNKAAKTYLAQARIALGKSVVDGVPTASNAWVLKGDKTIEGQAVLYNGPQQGWYTPAITYAIGLHGAGYNLTGITPVGLPAILFGTNGKIAWGSTVGSLDTNDVYQLTLNPSNSKEYLYKGTYIPFEHKQVKIKVKNQADHVLDVYKSKQGFVSTWDENNHTAYAQKRSWEGVEIETLLGWANAAKASNWDEFLAQAKRVTASITWFYADTKDNIGVAALGRLPIRPENQHIQLPAKGDGSMEWQGFYDFSHNPKEYNPQKGYVTSWNNKAYAGLRSDSSNFSYVDRVNELIEPLESKAKLSQQEIWEINKTAAWSDLNARYFVPYMIQAAQSPKATPLAKKVAPLLANWDLKLRPDSEAKYYQGAAPVITRAWLNQMIELVLKPNLSENIYKRYTDTLYPVNNDPRSAQPASASKLIWNALQGKQASVPQNVDFLKGQTADEVVLKALENALTELSNQYHSTDPNDWKIPVATMGFSSKNSVGIPWADPSHEQKLSTYGNTGSATFRVVLNPNQVTMCSILAPGQSGFINQNGKPDAHFADQLSLFESYKCKDDAVSQKEIDQSTQQSITLNY

SEQ ID NO: 7537 - protein, 240 aa, Acinetobacter baumannii
KLHFSYKITDFCYHDKNRFFIGFLVFGITDLTTYIIGTFLIVLLPGPNSLYVMSIASRYGIKTGYMGALGIFTGDLILMLCTVLGAASLLKAFPWVFIVLKLVGALYLSYLGFKLLQGSIQRWKLRNQPQAEMADLPALDKVHPYKTALSISLLNPKAILFFLSFFVQFVEPDYAYPALSFLILAVILQIISFSYLTALIFSGIKLSTFFKQNHKIAASGIFLVGILFFGFGLKLATSTM

SEQ ID NO: 7538 - protein, 292 aa, Acinetobacter baumannii
PINFKSMDKTFESFWITCKDGYQLAAQFYPAQEKKAEYPILICPATGITKNFYHSFATWLSQQGYDVLSFDFRGIGESLHGALKQSTASITDWGTLDIPAAIDTLLIKTKVNQVILIGHSAGGQLLGVVPNYNKVAKVITVAGSTGHIKGLKGKTKVLAPVMFNLIFPISNLVKGHGATQFIGMGENLPKKVAQQWREFCSRPGYVKNAIGKTIFHDFHSDIQCPITAIWADDDEIATKRNVQELLSLYPNANKKMIELSPKDLGYKSIGHMLLFKKSHQKLWSILEQEIKH

SEQ ID NO: 7539 - protein, 77 aa, Acinetobacter baumannii
DANFSFFVVDEMLLDATFWLDSLRGTVFVLSEDTSYIAQHNVTALTATIPIFFINIPIELSVKFLESSVKVKFIINI

SEQ ID NO: 7540 - protein, 285 aa, Acinetobacter baumannii
RSNFLAKCSNQILKELIFFQRYKIMENFLKDRKYIDLSVTLENNPYTDPPPLLPKIEYMDHQEGWPEMEAMFPGLELKDLPGEEAWAAERLIITTHSGTHMDAPWHYSSTTDGGKPAYGIDELPLDWCFRPGVKLDFRNKPDGHVISASEVQEELSRIGYTLSPLDIVLINTSAGAYFGQPEYLGKGCGIGREATLWMLEQGVRVVGTDAWSWDAPFKYTKERFAETKDASIIWEGHKAGRDIGYGQMEKLANLENLPDYGFLVSCFPYKIKHASAGFVRAVAIL

SEQ ID NO: 7541 - protein, 139 aa, Acinetobacter baumannii
NYFVIYFLKLISKYGAYSLILLKYIFLDFLNNMSYQLVELENATANIICPICKFAVIDWTQEQYVQPCEHTVFIAMDLGFEFVADRFEEVMKQNVDELHEDPNMNIFDAITTTPYKNLTILKAELGVDGLFRYVGISDC

SEQ ID NO: 7542 - protein, 227 aa, Acinetobacter baumannii
LSDVMSLYATQDEKKQAAAKAALKHLPKGGILGVGTGSTVNFLIDLLPELQLEAAVASSQATADRLKKLGIEVVDMNHVGSLDAYVDGADEIDRHMHMIKGGGAALTREKIVASIAKKFVCIVDDSKWVDQLGRDFPLPVEVIPMARSAVARKLVSLGGDPVYREGVVTDNGNVILDVFNLNILNAIDLEKTINNIPGVVTNGIFALNPATIAIVATNDGIEERTAQ

SEQ ID NO: 7543 - protein, 359 aa, Acinetobacter baumannii
VSCVMTNANDSNWIIYGANGYTGELIAREAVRQGLKPTLAGRNKAKVEALAQELGLGYKAFGLDNVDAVSEQLQGFKLVMHCAGPFSATSKPMMEACIKAGAHYLDITGEISVFELAQSLNSQAERADIVLCPGVGFDVIPTDCVAAALKEALPDATHLALGFDSKTGLSPGTAKTSTEGMAEGGKIRKDGKITTVPLAHYVRTIDFGDGKKSAMSVPWGDVSTAFYTTGIPNIEVFVPAFPKMIFGAKMLNYVRPVLKINAVQKFIKSRIEKTVVGPNEELRAKVPTYVWGEARNSRGEIKTARIQTENAYSLTVNGSLTVVNYLLKNTIKGGTYTPAKLMGYKLVTELPGSGPLVIT

SEQ ID NO: 7544 - protein, 278 aa, Acinetobacter baumannii
ASIVQGSVMSKDERIIQNQDNKKTIRHEDYIAGIGKGMAILDSFSSNQHRLNISMAAEKTGLTRAAARRHLLTLEYLGYLESDGHYYYLTPKVLKFSGAYLGAAQLPKVSQPLLNLLTNQTSLIYSVMVLDGYEAITIARSAAHQQTDRVNPYGLHLGNRLPAHATSAGKILLAHLSQEEQLDWLQKYPLQRLTKYTHVENDKFLELLKEIREQDWCYSREEHELGVHALAVPIYGQDFKVVAALNIVSPTMRTTEEYLIQHILPLLQETARDLRQVL

SEQ ID NO: 7545 - protein, 309 aa, Acinetobacter baumannii
QQVVCVYDPIGKSGDAFALAKDYALEAKNWGADLSLKAYVDERIAAEDLKVGKCDGAIISGLRGRQFNKYTGSLDAVGALTNMKTAINAYKLLSSPMAAKNMVVGPYEIAGLGTIGPAYLFVNDRSINTLAKAAGKKIGVFKYDEAQPKLVQHVGGQAVSVDVTNAGAKFNNHEIDIVPAPIVAFKPFELYKGLGEKGAIVRFPLTQISANFIIRKDQFPAGFGQKSRTWVASQLNRTFGIIAKYESDIPSKYWMDIPKNEQLNYMKMMREARIQLTKAGIYDPKMMNFLKKVRCKENPSNFECVLNDE

SEQ ID NO: 7546 - protein, 271 aa, Acinetobacter baumannii
LLNVLKHFKEKQMPSFQSADAQINYQTFGEPSSPALVFSNSLGTNYGMWQKQFNELKDQFFVICYDNRGHGSSSTPDGPYTVEQLGEDVVRLLDHLNISKAAFCGISMGGLTGQWLAIHYPNRFSHVVVANTAAKIGQEQAWLDRAKLVREQGLQPIAATAASRWFTDPFIQSHPSIVNNLCNDLSAGSAIGYANCCEALAKADVREQLKDIKIPVLVVAGTQDPITTVADGEFMQQRIPQSKLTEIDASHISNVEQPEAFNKILTDFLVN

SEQ ID NO: 7547 - protein, 627 aa, Acinetobacter baumannii
ENDVMITNRQNVQNNTNTSPHPITKNTLIDRFSPIYWRIDGPQTMSFAITNYGNGFEASFRSRMTNDLVGISWDSYDTKDHKLLAYETKYSYAGVVWDFDIELSASMPVLNNPSLTPTLTVYYHDNGVDKIAYIVLFNYANNPSSRTAHIHINWDTVKAGFSATDSFPVTNIQRISFSGFTSHYNGQSATPLSQPEDGYIRITNSVVTGTNAKLNLSRVVVPQHNYGICTSYDDHYDLNPQRLVNNMVALGYQGLVNHYCGMSHYPEMTWKSDINKWQIPDTLVTGEAVVNACTRKWHEKYAQALHNANMQPIFGVSFEMYSLGANEFWAQRDWNSNLGKTGYQPPSYFFSLSDQNALAYLHKVFIEFTDTMVAGGCNVNIQIGEPWWWYNTDTNLPCVYDYPTKLAFNADTGLYAPDLGTIYEAMNKTGTPYDEFKTWLRNKLGQTCQNIRAAIKAKYANAQVCPLIFFPSIRSPIQTLATYINYPSQHYSYPNFDYIMTEAYDWLLEAKLDLAHQAVSQIPTQDLGYPANKVAYLSGFVPDASIAYIYGFDKNKPYRTPSWQRIFGDMKNNVSLGLMKQFIWAYPQVMFDSITIDTTQAPNGFFVENTLYSPISDNTPYPPDIYL

SEQ ID NO: 7548 - protein, 234 aa, Acinetobacter baumannii
SWSVRNMNKVVLFDMDGTLLDLAFDDFIWNECLPKRHSETHHLSLTESQEILNQFYRSHKHTLAWYSSNFWTQTTGVDVLKLQQEFQHKIKARSGCMELLSALKAQDYQCWLVTNADCESLKLKLDNVPIQDFFEVIVSSEQIGYAKEDIQFWKELQRLHHFAPESTIFLDDTLPVLKTAEKFGIRHLFTILQPSSLKSIRQPQDLGYKALDQLTELLSILNQIDRKDNDVKIA

SEQ ID NO: 7549 - protein, 458 aa, Acinetobacter baumannii
ARSFLHCSRTCRYTARRDCGVCAMSKNIYDVAVIGAGCAGVVAARDLSSAGHKVILLEARDRIGGRTYTGEAFGRQVEFGGAYAHWTQSYIWRELQRYSIGLNPPTEVDKVVWFADGKLHTGTQVEYATLIEPLLTAFFNDARQWFPLPYDISVIDTSDIERQTLRDRLDALNLSTYERDVLDGLLSTLVHSWDEQGIAQLLFWAATYFGNWGAFFEVAGSWPIAGGTQKLVRAIHNDSSAELRLSTPVTNIDDHGEQVVITTQSGEKIMAKKALVALPLNVIADVKITPDVKKPVQDMIDAKHPMQTAKLWVLARGKFEPFVAFAPVEQNPINTVRVEYEHGDDSILVCFISDESTIDTNDIEAVQKALQMFKPDIEVLDVVSHNWTKDPYAQGTWVHYRPGHLTDAAPFMRKPHGNIYFAGGDIATMSMGGIEGAIESGIETAASITHALAQKLAG

SEQ ID NO: 7550 - protein, 68 aa, Acinetobacter baumannii
YKSLILLKLKLAFMTIHHSIASQKRLSKPVLKKEENLLSEEVFYQITSLINSLCLLKGKYLVDTVCYH

SEQ ID NO: 7551 - protein, 111 aa, Acinetobacter baumannii
NNIVRLIFMNLELDQDGHLVDYTIWNPEVAQELAKSLDLELTDWHFEVLAAVRQFYQQFGHSPATRPLIKFLMKTVSPDINNAVLQQKFNTGLVARHLSRLAGIPKPANCL

SEQ ID NO: 7552 - protein, 275 aa, Acinetobacter baumannii
EGIVLATPYITIGCPTTGGGQVISGNSMFLIDGIPVACVGDKATCPTHKVVATIVSGDPNMQIFGKAAARVNDSLSCGCKLLPQQNLVVQDNGGAASSGAKSSSAPMSQKQQTTDSFREEKYENYYIEQYKTDVYISHKAVLLGDEGVTPLDGAVSYFLNYKVQGKELFLSVVINAAPLSHKGTVYPFGTAIVSREGKEIARTKLKSDQGYWPTDKNKAPLGSCTIKLPEPNLQLVDVELELGYTAVISDTVGSVHPMPPIKKYKFSLNSAARKV

SEQ ID NO: 7553 - protein, 294 aa, Acinetobacter baumannii
KYGFSTLVCHRAILYHASINVRKMMMLYELFLFGLLSGVTTWLFGFGGGFVAVPLLYTVIIQKWSNESSVGIHAMQIAVATSAFVMLCSASFAVFRHYRSGHIDWQKIRFLWGGIALGGIVGAVMASLFNGNWLRWIFMGYVFITILDCYYRPGFIVTSRQKQHYGQNSELIKGGIIGWVAALLGVGGSVMTVPLLRRRGSSMAEAAAIANILTLPLSLTATLTYCVLSVWQSEWAPSGFIGLIWFETALFLVAGTWIGLYFSEKFISKLPDLWRAKLYPLLLIIVLLVMFFLN

SEQ ID NO: 7554 - protein, 65 aa, Acinetobacter baumannii
STPVGRITKCGALLLTNISSQTRIACTNKEKQMWYFAWILGILMACFAGVLSALYIEHHQNLDEE

SEQ ID NO: 7555 - protein, 180 aa, Acinetobacter baumannii
ITGFLVSQRHNDMNLYPIPADFINEKVNLSWCDIKWGYENNLLTSEIPIKKAENSLLTENYTNTELELSFLIPSESNDITPFINELCPNFKEDEYENISEKWLYVILSWLWANRESFEDPLDEVENIYTDFDCPAEMDSFIKYMPPTDGYDPSLYSYAENINRLMKNWESYLQKSAEKYK

SEQ ID NO: 7556 - protein, 386 aa, Acinetobacter baumannii
WGGFIMIEYELLKIIWWVLVGVLLIGFALTDGFDMGSMALMPFVGKTDNERRAAINTIAPHWDGNQVWFITAGGALFAAWPMVYSVAFSGMYWALLLVLFALFLRPVGFDYRSKLENTQWRNSWDWGLCIGGAVPTLVFGVAFGNLFLGIPFSLDSTLRSEYSGSFFALLNPFALVCGIVSLSMLCAHGGAWLMLRTDGALKQRSAKATQIMAAIFLVCFLVIGAWLYFGQVPGYSYAAAVDPNAALNPLAKEVVTNNNPGWMNNYSSYPITKVAPVLAILGAIIAFFTASKAKAGLSFAGTSLMIVGAILTAGFALFPFLLPSSVNPNSSLTMWDAVSSHRTLGVMTVAACIFVPIILIYTSWSYYKMWGVITNKHIESNSHSLY

SEQ ID NO: 7557 - protein, 62 aa, Acinetobacter baumannii
IRQVLLKFDSSLIPSYKNEEDFILWLADFIDRITIDTSKGDYPIKKNLANLSSIAEKLIYRH

SEQ ID NO: 7558 - protein, 389 aa, Acinetobacter baumannii
NLKVNWRNNMTGIVDIAIIGGGIGGMCAAIQLKKLGKNVSLIEIKDTLKPIGAGITLSAATLRALKEVGVVQELFKVSGQFSQFDMYTSDGHKIAEAPIKPAIGAEDLAANSIGVMRSKFAEVLENKLRELGVNVILGTTVDKLENNKDSVKVLFTNGQEQQFDLVIGADGIHSKIRHLVFPELPESTFTHQGAWRIVVPKYFNNFSMLIGKTLKASFSPISDSQSYMCVLDRHESDDFIEQHLWPEKLSGLLAEFGSVVQEVKADIDQGKIKAEDILYRPLHTLLVEESWHKGRVVLLGDAVHSTTPHLASGAGLAIEGAILLSEELAKDQPLEDALNHYQERHFDRAKMVISVSTRLGEIEMSNGSPVEHRELATKAFEALTQPLKA

SEQ ID NO: 7559 - protein, 409 aa, Acinetobacter baumannii
RTKVRMKNAYIIDAIRTPFGRYAGGLAPVRADDLGAVPIKALMQRNPNVDWEQVDDVIYGCANQAGEDNRNVGRMSALLAGLPYQVPATTINRLCGSSLDAIAIAARAIKAGEANLVIAGGVESMSRAPYVMGKSDSAFGRSQKIEDTTMGWRFINPKLKELYGVDTMPQTAENLAEQFNVNRADQDQFALVSQQRTASAQAKGFFSKEIVAVEIPQRKGDAVVIDTDEHPRASTTLEGLSKLKPVVKADGTVTAGNASGINDGAAALLIASDEAVQSYNLKPRAKIIASTAVGVEPRIMGFAPAPAIKKLLKQANLTLEQMDVIELNEAFAAQALAVTRDLGLPDNSDKVNPNGGAIALGHPLGASGARLVTTALNQLEQTGGRYALCSMCIGVGQGIALIIERVEAL

SEQ ID NO: 7560 - protein, 556 aa, Acinetobacter baumannii
NERVRSSTQKQTCSYATRITDRFSYYSLRNIKMVIGHNFIGGSRSAQGTTLLKSIHATTGEALPYEFHHATEQEINQACEAASQAFKTYRHTTPEQRAVFLENIADELDALGTDFLEIVSQETALPLARLQGERARTSGQMRLFAKVLRRGDFLGARIDTALPERQPLPRPDLRQIKIGVGPVAVFGASNFPLAFSTAGGDTASALAAGCSVVMKAHSGHMATADFVAQAIERAVEKSNMPKGVFNMIYGNGVGEPLVKHPLIQAVGFTGSLRGGRALCDMAAARPQPIPVFAEMSSINPMLMLPKALKNRGDKIAQDLADSVVLGCGQFCTNPGLILGIKSAEFSQLISKLTEIMGAKPAQTMLNAGTLKSYTAGLEHLTEHQGIEHLAGQTQQGNQAQPQLFKADVELLLAGDQLLQEEIFGPTTVIIEVEDKAQLIQALQSMNGQLTATLIADEADLTEFADVVPVLEEKAGRLLINGYPTGVDVCDAMVHGGPYPATSDARGTSVGTLAIDRYLRPVCYQNYPQSLLPEALKDSNPLQILRLVNGEMTREAI

SEQ ID NO: 7561 - protein, 165 aa, Acinetobacter baumannii
KGRVYMVAQIRIGQGMDVHAFEEGNFVTLAGVQIPHTHGLKAHSDGDVVLHALCDALLGALALGDIGQHFPDTDPEFKGADSRVLLKHVYQLILDRGYHLNNADITVACERPKLAKYNLEMRQSIADVLNVDLNQISIKATTTEKLGFTGRQEGILATATVLISH

SEQ ID NO: 7562 - protein, 474 aa, Acinetobacter baumannii
SNSVNLYSVIARNTPGTSMLQKVLIANRGEIALRITRACKTLGIKTVGIYSDADKDLMHLRFVDEAVCIGPGASSDSYLNIPAIITAAEITGADAIHPGYGFLSENAEFAEIVESSGFTFIGPRPEHIRLMGNKVSAIVAMKKAGVPTVPGCDHAVTIHNALAEAKEIGFPLIVKAAAGGGGRGMRIVERVDTLLESVQAAQRDAEMWFGDDTVYMERFLQKPRHVEVQVLGDGNGHAIHLYDRDCSLQRRHQKVLEEAPAPNLPEQARADILQACVHACQLMQYRGAGTFEFLFEDGEFFFIEMNTRVQVEHPVTEMVTGVDIIEQQLRIAAGLGLELQQEDIEVRGHAIECRINAEDPTTFLPSPGKIESFYAPGGAGIRLDSHIYPGYSIPPYYDSMIAKLIAHGKDRETSLARMRQALDEMILTGIKTNIPLHKDLILQDKNFCSQAMDIHYLEKHLLKQVEEEKKAETA

SEQ ID NO: 7563 - protein, 355 aa, Acinetobacter baumannii
SIEVFEMDENKSKALQAALSQIEKQFGKNTVMRLGDNTVQAVEAVSTGSLTLDIALGIGGLPKGRIIEIYGPESSGKTTMTLQAIAQCQKSGGTCAFIDAEHALDPQYARKLGVDIDNLLVSQPDNGEQALEIADMLVRSGAIDLIVVDSVAALTPKAEIEGEMGDSHMGLQARLMSQALRKITGNAKRSNCMVIFINQIRMKIGVMFGSPETTTGGNALKFYASVRLDIRRIGQVKEGDEIVGSETKVKVVKNKMAPPFKEAIFQILYGKGTNQLGELVDLAVQQDIVQKAGAWYSYQGNKIGQGKNNVIRYFEENTQIAEEIERNIREQLLTTGTNGAVQIEDEEEPDLLLES

SEQ ID NO: 7564 - protein, 223 aa, Acinetobacter baumannii
PSLLNFMHDPVLESHHLVCEKTQTRRGIERRLALLLSATELFLEKGYDAVSLDDIVNHAGGSKTSIYKYFGNKDGLFTAICDYRREMFFKDICIAFQPEQTSLKDYLIQTLIRFYKHIIQPEHIAFLRLVIEQTQCNATLSQYLYEKCALDVQNTIAQALLISHQSGEITCTSPDHSSLMYFGILRDIEWRMIMGMPLPPNETEVIDYINYCVDIFLKGHHKV

SEQ ID NO: 7565 - protein, 308 aa, Acinetobacter baumannii
KGILMELRHLRYFVTVVEEQSLTKAAEKLFIAQPPLTRQIKKLEEELGIDLFEKGSRPLKVTEAGLFFYQHAVQILTHTAQAASMAKKMKLVENVVKVGYVSSLLYGRLPQVIYLFRQKNPDIHVELIECGTRDQVEALKLGKIDLGFGRLPISDPAIKRLLLRKEKLKLAIHKKHPLSDFQESGIYLSQIINETIFSYPTTPKPNFSTTIQALFTKLGLVPAKLTEVREIHMALGLVASGEGICIIPESACDIGMKNLTYLNILDLEAYSPISLSMRNMDQSSYIPKILDCIEEIYSEEEVSRNLNL

SEQ ID NO: 7566 - protein, 443 aa, Acinetobacter baumannii
KVVFRSKLSGTNDRWAVLMKCSCISEESVMPHVIVIGAGITGVTSAYELSQLGYQVTVIDRHLYPAMETSFANGGQLSACNAEVWNQKATVIKGFKWMRQKDAPLLLNPSFSLHKYSWLVEFLSHIKNYEANTIETVRLALLARKRLFDVAEKEQLQFDLEKRGILHMYHTKDDYDIAKRVNDVLNKGTLERYSVSPEEMKSIEPSLTGEYFGGYYTPSDATGDIHKYSTSLAEKTKQYGVQYKFGLEVTDIKCHTDKVVLNCQPSAEHPHLSQTDSFQLEGDVLVVCGGVGSYQLADMIGERVNVYPVKGYSITVQLKDEKSIKNAPWVSLLDESAKIVTSRLGPDRLRVAGTAEFNGYNRDIRADRIQPLVNWVNRNFDISTEHVVPWAGLRPMMPNMLPVVKQSKQSRVFYNTGHGHLGWTLSAATAVLVSQDIQQKYPA

SEQ ID NO: 7567 - protein, 443 aa, Acinetobacter baumannii
KGFFMSTEYSQPSAIERETMRKVAWRLLPFLTICYVIAIIDRGNIGMASLQMNEDLGLTATAFGFASSLFFFAYFLFEVPSNLAMQKFGAKVWIARIMVTWGVISSATAFVENSTSLYIMRFLLGAAEAGFFPGVILYLTYWLPANYRARMVAIFMVAIPGANFLGSPLSGFLLSLDGWMGMRGWHWLFILEGIPAVLLGIACLFVLTDRPEQAKWLNSEQKSWLVERLQFERQQKTPIGHISLWQLLKNKYIWSMIIIYSGASAAGSTMSVWAPQLIKSFGLSNVEIGLVNAIPYGIASIAMILWGRSSDRKNERLWHTAIALLMISFGLLIALFTSSLIGTIFLLSIVLIGAYSAKGPFWALASSWMSPTTTAAGLAAIGACANLIGGGMMVNIYGAIHDATGSHAIALLPLAALNLVSAIMVFIMSRKKAVLFTQPQSTS

SEQ ID NO: 7568 - protein, 60 aa, Acinetobacter baumannii
VESFKCSNAYNAFVLWVFQAVFVNKDSFFYNVLKYFLEFGLIVAIEINALCTQFYDLIRG

SEQ ID NO: 7569 - protein, 246 aa, Acinetobacter baumannii
FNTLKLISRYCRKNMVKIKPHPATSGNASADRLLTLLTAFRIGDKSLTLAELAERTELNKATIMRLIVSLEDFGFVNRLSDGRYTLASEVMRLNTIYQDALDLERHVMPCLQQLVDEIGETASFYVKHGAYRLCQYRINSTHRLRVHVQPGEVRPMDGAACAQALKSTYEQVLARTEPFYSTGVTEPHAAGMALPVFDAQNEVVGALLISGPSSRFTAEVAKSVGDFFFKIADDLTKSLGGKSIRN

SEQ ID NO: 7570 - protein, 285 aa, Acinetobacter baumannii
MSQLKPQEVVRLGDIQMANHLPFVLFGGMNVLESKDLAFEIAETYIDICKRLDIPYVFKASFDKANRSSLHSFRGPGLEKGIEWLGDIKKHFNVPIITDVHEPYQAAPVAEVADIIQLPAFLSRQTDLVEAMAKTQAIINIKKAQFLAPHEMRHILHKCLEAGNDKLILCERGSAFGYNNLVVDMLGFDIMKEMNVPVFFDVTHALQTPGGRSDSAGGRRAQITTLARAGMATGLAGLFLESHPDPDKAKCDGPSALRLSQLEPFLAQLKELDTLVKGFKKLDTH

SEQ ID NO: 7571 - protein, 333 aa, Acinetobacter baumannii
NCKFYVLKGFEKSLKIRLEIYWLCATIYSSKVIRQKEDDMAIQLLDAARNEIPVKFTQFSGGERHVQIDETTLGSLYGNVLVRAHMASSHDVMDYLLLENILLTQGLTIDLEVPYFPYARQDRICAVGQAFSLDVMTKLLNINADKKAGKQGKVTVWDCHSEVTTALLAANTSFSEVVNVSSVDIIAKSEALSTLLKDEKTVLVCPDKGAKARTQMVADAFNSKRKQPITIIQCDKKRDPVTGKILGTHVHATDLSGLTAVITDDICDGGATFIGIAKELRRLNCHKVVLYVTHGIFSKGIEVFDGLLDQLFTSDSFPQQPSDKISVIAFAAE

SEQ ID NO: 7572 - protein, 336 aa, Acinetobacter baumannii
MSKLEKTQLQLGYIPLLDCIALLWAKQQGFFEEVDLDVTLVKEASWASLRDRLAFGLLDAAHCLSAMLPAAAMGADQIGIALQTPLVLSKNRAFISLSQKLIHQLAIKENDNAQTTAQKVIQYIEQDHTLSLAHVFKHSIHHYCLREWLALADSRIAQTLKLKALPPPYMVEALDNHVIDGFCVGEPWNTQGELLGLSKIVCSSQDIIPNVADKVLAVTQEWAEQHPHTLVALTTAIMKAQKELSNLKDFAPVLKLLVEFGIVRFHCSEEVHVDKYYMIQNIVKHLVKENAAPQPEDFHWLFQQMQKWEKLQLAPDQIIELSAQCINLDCYNQAKL

SEQ ID NO: 7573 - protein, 387 aa, Acinetobacter baumannii
MSKLIQPISFKALFIFTPLLFVSIGCSETLYSQTIPSVKSSSENIDYPEIDTALGEKLQPNEEVIAHQITQVIEKSIREQYTAGNALRDAHPKAHGCVRAEFHVLKNIPAQLAKGIFIPDKNYEAWIRFSNASNDASRADIEKDARGMAIKILGVSGQKILENEKEATTQDFIMINHPVFFVNDGQRYLSFMNDLNSHNMIRKLHMPFALGFKGTMNALGARNSKIANPLYTRYWSMVPYQLGLGVDRQAVKYSVRNCSTVSATLPDHPSHNFLRDALKDTLQKQDVCMEFLIQPRTSTKMLVEDAMFEWKENEAPFYQVATIHIPKQSFDTPEQNQFCENLSFTPWHALPEHKPLGAINRMRKIIYENISRVRHDINSAPRQEPKN

SEQ ID NO: 7574 - protein, 256 aa, Acinetobacter baumannii
LTKFTPFITTIKNFNKFLAVVIHHVTSCSKVSHMIDKSKSSLSEVLSQIKDGATILIGGFGTAGQPAELIDGLIELGVKDLTIVSNNAGNRDYGLAKLLKAGSIKKVICSFPRQSDSYVFDELYRAGKVELELVPQGNLACRIQAAGMGLGAVFTPTGFGTLLAEGKETRHIDGKDYVLEYPIKADFALIKAYKGDRWGNLVYRKSARNFGPIMAMAADVTIAQVCEVVELGGLDPEHIITPGIFVQHVVQVQPAQ

SEQ ID NO: 7575 - protein, 175 aa, Acinetobacter baumannii
INSSGLMMKKLLITSMVALTIGLNGCASIITGSSQTLTFTSVPESATIEIKNRNGVKVHTGQTPATVSLKKGAGYFKPESYQVSFSKPGYQTKTVEVTGTLSGWYLGNIIFGGLIGLLIVDPATGAMYKLAPKDINTVLEAQNLVGEAKQKPTLTVMLAQDIPEQMMARAVQINK

SEQ ID NO: 7576 - protein, 264 aa, Acinetobacter baumannii
MRASTVTIKTEQDLEKLRVSGRLAAQVLEMIGEYVKPGVTTEYLDNICNDYIVNTLKVIPANVGYHGFTKTICTSVNEVVCHGIPSQNKILKDGDIINIDVAIIKDGYFGDTSRMYYVGNVNPHAKKLVETTYEAMVAGIHAVKPGATLGDIGYAIQSVAHREGYSIVREYCGHGIGKVYHEQPNILHYGQRGQGLVLKKGMVFTIEPMVNAGKPQVKELNDGWTVITQDHSLSAQWEHMVAVTDTGFELLTPWPEGVGNYPEI

SEQ ID NO: 7577 - protein, 185 aa, Acinetobacter baumannii
IDYSTLGATAMTDKVNIAEIIERLEQLEAHNAIRNCINRYMEICDELNANTDLYELMNLFDQDCIWEGIGDKYSKSFGRYDSWQSIYDMFKRYTQKESHFVMNAHFVNSEQIYVNQNDANASWLMLQTSTFQDGRSHLNAAKLKVKFQKQADGTWKIKHFQTQNIFSRPVSHWQSEAELPVPSQE

SEQ ID NO: 7578 - protein, 95 aa, Acinetobacter baumannii
LKHSVLAQPQGGMEMLSLHFNKQVFINTLNSKDSVVYGVTTLALMLTLLFQGMIKGNLKPEYFMYAMVVSFVFCVWAFVDHKMRKLAKRRLSQQK

SEQ ID NO: 7579 - protein, 358 aa, Acinetobacter baumannii
ALNSSSYLHIRFVPIRKNKMTISNTTDLSSPLMPSQQHNGKFRNTRPNQHQPSFGKTLQLMWKFLFNKPKDTVPNTAIPVLSLSKEQLLSAPDRSLFRLGHSTILLKLQNEFWLTDPVFSERASPFQWIGPKRFHQPPISIANLPPIKGVILSHNHYDHLDYHAVMELNDKVEHFLTPLGVGDTLIKWGIPAEKVQQLDWWDTTHVDGLELVATPAHHFSGRGMGDSNASLWASWVIIDNDLRVFFSGDTGYFDGFKEIGHRYGPFDLTMLETGAYDPEWPDVHMQPEQTLQAHLDLKGRHLLPIHNGTFDLALHAWDDPFERIVALAQQNNLAISTPQMGQILNLNEPNVENYWWRS

SEQ ID NO: 7580 - protein, 237 aa, Acinetobacter baumannii
CVGSSQAMMFSLTPEELSVLQLSCKVAASCLVVSIIPAICVGWFLARKDFWGKSFIETLVFLPLVLPPVVPGYLLLQVFGSRGIIGQYLAPLGINFAFNWKGAVLASAVMGFPLLVQSIRLAIELVDQRLEMAAKTLGASSLGAFFHVTLPLASSGILIGAILCFCRSLGEFGATITFVGNISNETRTLPLAMYSLMQQPDTEAAIQRLIVLSLSVAFLALWFAQWFHRYQKKRLGR

SEQ ID NO: 7581 - protein, 471 aa, Acinetobacter baumannii
MTSSNLKQWNDFIDGCIDFRPNDGVFRIARDMFTEPELFDLEMEFIFEKVWIYACHESEIPNNHDFLTVQIGRQPIIVSRDGKGELHAMVNACEHRGATLTRVAKGNQSTFTCPFHAWCYKSDGRLVKVKAPSEYCEDFDKSSRGLKQGRIASYRGFVFVSLDTQATDSLEDFLGDAKLFLDLMVNQSPTGELEVLQGKSSYTFAGNWKLQNENGLDGYHVSTVHYNYVSTVQHRQQVNASKGAELDTLDYSKLGAGDSETDDGWFSFKNGHSVLFSDMPNPTVRPGYSTVMPYMVEKYGEKYAEWAMHRLRNLNLYPSLFFMDQISSQLRIVRPVAWNKTEVISQCIGVKGESTEARRNRIRQFEDFFNVSGLGTPDDLVEFREQQKGFQARLERWSDISRGCQSWEYGATKNSQDLGIQPVITGREFTHEGLYVNQHGHWQRLMLDGLNKKALKMQDITFENNAVMDEV

SEQ ID NO: 7582 - protein, 197 aa, Acinetobacter baumannii
SLKSKKHSKPYSNRRGQMSVDKYIEDLIKREGGYVNNPNDRGGATNYGITEAVARVNGWKGPMRDLPLDLAKQIYKQQYWINPRFDQVNTLSPLIAEELLDTGVNCGVAFAKPLLQRALNLLNNQGKGGWPDLAVDGIYGSATLGALKIFLAKRGKDGEKVMLKVLNIMQGQRYIEICERNPTQEQFFYGWISNRIA

SEQ ID NO: 7583 - protein, 169 aa, Acinetobacter baumannii
SIMSKFSDEYWMQLAYEQAELAAKQGEIPVGAVIVSQNKLIGAGFNAPIGLSDPTAHAEIQAIRAACESLKNYRLPEDATLYVTLEPCTMCVGALVHARIKHVVFGTTEPKAGSLVSARQLLENGYYNHKFTFEHGCLHEKCAQQLSLFFKQRREQKKQEKQQKTSLND

SEQ ID NO: 7584 - protein, 127 aa, Acinetobacter baumannii
QVYPSSVALLFEWNMDMNFQTILSSFKNQSTGTDAFKNLKSACEHHLKHSSHLNEKAVIYLIYGFARSYVILYEDEAVTTEFAQASKEMLVNYMNRLNEALRTQDDHIILNTLNQVSNDYMQGSRIF

SEQ ID NO: 7585 - protein, 114 aa, Acinetobacter baumannii
INMFKTKKTLQMLNFTHCSKTPFTIFYVKNKKMEIRMSKRHILKEVNAKSMCGMEIVVEQIFENTLEKNLASAEIEQNWLPLSKIVISDKVINLDQDNTFAHPRTGKVFKVLNS

SEQ ID NO: 7586 - protein, 382 aa, Acinetobacter baumannii
NDMLNLKSSHSTAFTPSSPAERYAEALASGQFMADEAQAQAVQELDRVWKELLNRYKASKKAFRRFRRQTSPKGVYMWGGVGRGKTWLMDQFYESVPFRRKTRMHFHHFMQHVHKELNKLSGQRNPLDIVADQIYKDAVVICFDEFFVSNVTDAMILSDLFQKLFVRGVTLIATSNIAPDGLYKNGIHRDRFIPTIEMVKKNCVVLNVDAGVDYRLRVLKQAQLFKSPLGNEAQSWISERYTALTHTQTNSHEPIVINNRVVETLGHTEDVLWCEFSELCLKPRSPADFIEIANIYNTVLVSNVPHLTDFLSEGTRRFIYLVDEFYDRGVKLLLTSQDSIIDIYQGEKLAFEIERTRSRLLEMQSDEYLHSEHRHIDATKTS

SEQ ID NO: 7587 - protein, 376 aa, Acinetobacter baumannii
ESMFQFIQQQTELVDVLQQMDQCSTYGLDTEFIKVDTLWPKLGVCQVNVNGNVYLLDGVSLDLSKFWKKIFLAQQNIFHACGEDIDLIYHYADEQNLLNVFDTQVGLSFLGHGLQVSYQGALKLCLEIDIEKDQTRSDWLARPLSPQQLCYAANDVLYLMQLANHIKDQLKQKGLYEYVLEDCSSLTKEIISETPTPLLYTDVGNYRHSRRQLMQLQNLSEWREEVVRATNQPRSFILRNSTMIDLVEKNPRNSFQLSQVKDIRPNVVREYGKIILDLLKDLPVEGHWPAKIAKPFKITSKETLNKMDALIAKAIEQTSIPKEVLLRKKWLNAIHQHVLTKGDEQDLPDYLLGWRYELLTKPLIQLFKEEKASLLF

SEQ ID NO: 7588 - protein, 749 aa, Acinetobacter baumannii
MRIPQFNSQVAEADMPNVQISGGVTPGQAVDMVGNKIDGFANLANTVANKYKEIQDENDRVRVIDAQNKLAELRLHLENNDTDGYIKKKGADVVGFDDGEGGNFVDYYSRAYQNGVGEIANKLSNSRQRTMFQQIAARDALQFKGTLQNYFVRENDVYQQSVYSSSAERFIREINENPADFTKIDESRENLKASLGKLMSLNGKSATEAENMYLKSISSAHLNNLNAFIQNGELKAAATYKKKYGDEISLADDYVINKRIHEKLEEQQIELLVNKATTGTQEYSNPALNAPPQASAAIAKELKALSPEQMKSIRYNDQRLDVYTVHAAKEKGMEWAAPLLLGIRLAGEKSDNSAVSRRGAKSVMQFMPQTWGEYSKGGKRDINNPADTIDAALEFVDWISKKYKTKDPMVIAAYYNGGGNAATAVLKGQQPPKAETQNYLKRIDKWLSDDMGPYSKQPAKTRQQAYDEIWNSNVPVETKQKALSLTERYFNGQDKVKKDRQDQEYSNLYNGIISGKFAFEQIPAGSITALEPSQINSLKSVSKATYNKDIKTDPITLSMITLNQEELFKGKPQSVLHQFADKLSPKDYEEVTKMYANVNALKGSKNEKKTFILDNNTVALAVKPYLNIIGITSTTDKRQLEHYNAVKTDLMQTLKEAEAKNGGNLTWEQVNRVVLKNINNQVKVTTSRPFFDDKVEYNRVYSQVKSKGDITDSMKTKIDNIFRKQGRNPNNVTDAEYINAYYSIMRRGY

SEQ ID NO: 7589 - protein, 497 aa, Acinetobacter baumannii
GNSPMKHTLEQKQAIDMAIDGESCKVTAYAGAGKTSTLKLIGNAKSYQSGMYLAFNKAIATEAQGKFNSNVRCKTFHSLAFNSVPRWFTKKLSNRRLMSNQIASRHDLESYQVPVALTKQRGEDDQKRLFNNKRMATSLINAVGYFCRSNYSEIQLSQVYAALPDWMEETHRAELAKILLPKANDYWQDILDPFGVNRLEHDHYLKYWALSKPVINTDFILFDEAQDADPIMLNVLNNQSAQVIYVGDRHQQIYAFRGAVNAMQSLEIPETRLSQSFRFGQDIADLANTILFNVLDEEIPLRGFEQIESQVCEVHDSVADAIIFRTNAAALSHMVELIQLGREPRLEVDTGSLIKNIEDAKKVKAGVRVADGSAFEGFSTWEEVLEYSHEVSNSDIKPLVSLIEKVGENALIEALLKSSSNDYDCVVTTAHKSKGLEFNKVKLGGDYFYKEAVSDGEKPLTADEARLLYVAATRAKKQLDITALNPLFKNIKSGVAA

SEQ ID NO: 7590 - protein, 456 aa, Acinetobacter baumannii
YYFLGDNMQQKQLNTPDDSVEQVTFWQAFLFWLKLGFISFGGPAGQIAVMHQELVEQRRWISEKRFLHALNYCMLLPGPEAQQLATYIGWLMHKTVGGLVAGILFVLPSLFILIGLSWVYIKFGDVPVIAGIFYGIKPAVTAIVFHATYRIGSRSLKNKFLWVVAIAAFFAIFVLKLPFPLIVLSAGIAGYLASKKYPELFSSAGGHKASQKDYGPAYIDDDTPTPEHAKFHWSRLARLIFVAIALWLLPILALGAYFGWHHSYTQMAWFFTKAALLTFGGAYAVLPYVYQGAVNHFGWLSPTQMIDGLALGETTPGPLIMVVAFVGFLGGVNHSLLGSEHLFFAGALGAVIVTWFTFLFSFVFIFAGAPIIESTHNEIKFTAPLTAITAAVVGVILNLALFFSYHVLWPQGFSGHFDIVAALITVAAFIALFRFNINVLYVIFASALVGLAVTFF

SEQ ID NO: 7591 - protein, 334 aa, Acinetobacter baumannii
VERPTISPEHLQEAAENLSTIRDFIRFGVSALRQYDAHLGQGTEDYFAESSALVLQTLSLEWSADSEILDAKLLPSEKAEFLSLLERRINERIPTSYLLNLAYFFNKPFYVDERVLIPRSPIAELIEQRFAPYCLDENGQMREALNNLPENTKPKTPQRILDMCTGSGCIAVALAYAYPDAEVDATDISKEALEVASINVEHHNKQYQVALLESDLFEKIPAENQYDLIVSNPPYVDAEDMADLPEEFLHEPELALAAGQDGLDLVRKMLAQAADYLTEDGLIVIEVGNSEWAMRQNFNTVDFNWLTFQKGGSGIFALTAEQCRRYRKLFEEQV

SEQ ID NO: 7592 - protein, 589 aa, Acinetobacter baumannii
VRKPMIDSKAVVQAHNLFMTFKAENKNSVDISAIVDLNMQIKKGELTALVGPDGAGKTTLLRLIAGLYKASSGSLHVLGFDIEKHPQVVQDRISYMPQRFGLYEDLSVQENLNLYADLHGVPKNVRNQRFKRLLEITDLTQFTQRLAGQLSGGMKQKLGLACTLVRSPELLLLDEPSVGVDPLSRRDLWIIIEQLVQEENLSVIISTAYMDEAEKCAYVYIMHEGKILRQGSPEQLKALVHEQTWKIKPSEQIKTRIVQAQLLGNSGEIIDAVPRGEQVNFISRQKELSTDIFPLGLVANRRPPELEDVFMMLLQQNQKQQISISQQAFRSEQNNNSQSDQAVIVVKDLVRTFGDFTAVANTSFTVQRGEIFGLLGPNGAGKTTTFRMLCGLLPASSGYLEVAGKNLRTARAEARAKVGYVSQKFALYSNLTVLENLKFFGGAYGLSGKKLDQQIDKALQQYDLKPQIKSGDLPGGYKQRLSMAAALLHEPEILFLDEPTSGIDPLARRLFWYSIGKLANQGITIIITTHFMEEAEYCDRIAIQDAGKLLALGSPQQVRELASKDKHIVDMNEAFIAIVEQARALRHAG

SEQ ID NO: 7593 - protein, 82 aa, Acinetobacter baumannii
IMAFIFKEVQHRTVAPVIIDEDKCIADKGCTVCVDVCPMDLLAIDPTTQKAYMQFDECWYCMPCEKDCPTDAVKVNIPYLLK

SEQ ID NO: 7594 - protein, 65 aa, Acinetobacter baumannii
FIKFMLKVTAALLILGSFACYLLWGNEEKAETKSSHMLKEAEQSIKNAELSIQKAKQNIPTASYQ

SEQ ID NO: 7595 - protein, 137 aa, Acinetobacter baumannii
EGVTKMYKILILLSFLVFSFSVNAAVEDDLKTSTRKALNKIDAQKEDCYKKAEFSATANGCLEDSFKRQKVIVDTFVDIKARKQDPEQLLRTYEDQDVFNKSIKACELLLKLSSPNDKYFYVYNCKLNALKQYFEYQ

SEQ ID NO: 7596 - protein, 84 aa, Acinetobacter baumannii
QSEFLTMLKPIIILVAIGAIGLVGYKVFAQKDEPTQINETVLLINDANKSVEEADHTIEKANASFQKIPLNEYKPDNSTLQASQ

SEQ ID NO: 7597 - protein, 77 aa, Acinetobacter baumannii
KNATESLMNNLFLNNFPKKRYFFDHYFKFFKFNILLNVYFLQKLFLIYIFIESFLKICFCLLKRFFDNTILFKKYLK

SEQ ID NO: 7598 - protein, 137 aa, Acinetobacter baumannii
TECTNTTHHRSTFYKINERLRGTLMQPQMGGIIQVNIPDRATLQASYMGYVQGGGLFVPSKQKVKMGQEIFILATLPEQSQKIPLTGKVVWISHKQSGFKPQGFAIQLSGDKGIYYKAEAERILAGSMSLDRPSYTM

SEQ ID NO: 7599 - protein, 97 aa, Acinetobacter baumannii
MASTKLKRKVRRGEMTEVKFVSMPASELAQVIEKACENAVTKVLAAQGDELLNITQLCERIPGLSYHSFKKLAKEHRFKDIKGRYSLTAVKAALQSH

SEQ ID NO: 7600 - protein, 316 aa, Acinetobacter baumannii
GIITMLAYVIRRLWQMIPTMLGVVLLIFILFNWVGGDPAYILAGKMSNPEQIENIRKQLGVDQPYYVQLWIFIKQILTFDYGASWSTGESVSQIILTRLGPSLTLLIPLTILQTVISIILALAVAAVRGSLTDRMVMMLCTIGMSISILVYIIVFQYVLAYQLSWFPVQGWSDSFTDNLFKFSLLPILIMLVVSIAPTLRLYRSFVLDEVNQDYVRTARAKGVGESRILSVHVLRNASIPIITDVMSNLPALLIGAFLIERFFGIPGIGREVIIAVERSDFPVIKAITVYIAAATMIFNLIADLVYKVVDPRVQLK

SEQ ID NO: 7601 - protein, 139 aa, Acinetobacter baumannii
TLRFSKMTTISKSLLNGLPIKKSRVQVFEILNQNPQGLSAVSIYAQIKNEHKITLGTIYRILSEFENRKIIKRVFLGKSKSIYKLRKDKMSCNLISLKTSEALNFENEKVKELLHEVTDIIFANTGVDISSVELNLYTE

SEQ ID NO: 7602 - protein, 233 aa, Acinetobacter baumannii
FFLTFRHKKAPKFWRRTGRSKQALLLHCYSTAKDNGVIMEQNIMVSQISNNHRNLIKGLIRKQKVKRIKNALRIQRDQLIAAIKDAYKNSPALGFGTCFIGGIVVLVVTMSFALASAHMAYKNLGPQQISIFSPIYTVDDLDLGPYNDCHTDCHASILTSDMRFRIEVGFDFSGYDNSNGFNRATGIQIDRLEPINVVDEEGVVNAYIDRFELVKINEALEESIETKLAKLGG

SEQ ID NO: 7603 - protein, 729 aa, Acinetobacter baumannii
KVATSGKTMTARIQKGKLAIAKELYDFIENEALPGSGLDSETYWKNFEQVVVDLSPKNKALLAKRDELQAKIDEWHRNNKFELGAYKAFLTEIGYLLPEVEDFQITTENVDEEIALLAGPQLVVPVRNARYCLNAANARWGSLYDALYGFDVISEEGGAEKGKGYNPVRGAKVIEFAKNFLNEIFPLAQGSHADATKYAIEQNKLVVTLKDGTKTGLAHEAQFVGFNGEEANPSEVVLLSNGLHVIIEIDANSPIGQTDLAGVKDLTLEAAVTTIQDLEDSVAAVDAEEKVEGYRNWLGLMKGTLQESIEKNGKTIVRALNKDREIKNLIGGTTKLHGRSLMLLRNVGHLMTNPAILVDGEEIFEGIMDALVTPLLSIADIRSENENKNSRKGSMYIVKPKMHGPEEVAFAVELFERAEQALGLPAKSLKIGIMDEERRTSVNLKNCIAAAKDRTIFINTGFMDRTGDEIHTSMEAAPVVRKEAVKTQKWIAAYENRNVAIGLKCGLQGKAQIGKGMWPKPDSMKDMLATKAAHPNAGASCAWVPSPTGAVLHAMHYHQVNVKARQDQLKAEEMLSLDDLLTPPFATDTNWSAEEINNELENNCQGILGYVVRWVDLGVGCSKVPDINNVGLMEDRATLRISSQHVANWLRHGIVTREQVEEVLKRMAKIVDEQNANDPLYKPMAANFETNIAFQAASDLIFKGCEQPSGYTEPLLHAARLKLKGYTGD

SEQ ID NO: 7604 - protein, 345 aa, Acinetobacter baumannii; identical to SEQ ID NO: 5480

SEQ ID NO: 7605 - protein, 94 aa, Acinetobacter baumannii
SMQTRPDIRVDTINKQVHFIWTDGSSVCLSHQSLREICPCGFCRAKRIKQIKIEHQNVEVTAMFDQGYGAQICFNDGHDKGIFPWAFLKEFATG

SEQ ID NO: 7606 - protein, 349 aa, Acinetobacter baumannii
TLETQLAARYEEYSDFGDTFNPKFALRWEPIKQLMFRTSYSTGFRAPTLWEVNAPNSITNTSAYYNDPVLCPNGPPKNPGDTLPPGGVASRDCETQFDRKNGGNKDLDPEESKSFTAGLVLEPIKNLVLTLDYFNIEVENQIAALPEGDIFNNPTKYADKFVRNPDGTLNHIITTQDNMGDLKTSGVDVSLNYITPMTATGRFGFGIDGTYVIKYKYQNEKDGEWISSLGAYVGDAPIIRWKHTANLYWNYQNWGVNFQQQFTRGYDDQNSSSSVAEGYRDHKVSDYTIYNISGTYKGFKNLEVTAGIKNIFDEDPPASNVGDNFQMGYDPRYADPLGRTYFVRGTYKF

SEQ ID NO: 7607 - protein, 156 aa, Acinetobacter baumannii
TPMTPACRLLKSNKIEFSIHEYEHDANAKSFGLEAAEKLNLNVNEVFKTLLVTDEKNYFVAVIPVNHQLNLKKVATAVGCKKLQMANPKDAERLTGYLVGGISPLGQKKRLKTVIDASAQELSKIYVSGGKRGLDIGVNPKDLAQILTAQFVDLLD

SEQ ID NO: 7608 - protein, 386 aa, Acinetobacter baumannii
FSMTEGVGLPLWLLAELTYRCPLQCPYCSNPLDYAQHKNELTTQEWFDVFDQARQMGAVQLGFSGGEPLVRQDLEQLVAHAHQLGFYTNLITSGMGLTEQRISHLKQAGLDHIQISFQASDPVVNDALAGSKHAFEQKYEMCRLVKKYDYPMVLNFVIHRHNIDQIDKIIELCLELNADTVELAICQFYGWAFLNRQGLLPTQEQLIRAERITNEYREKLKAQNHPCKLIFVVPDYYEERPKACMNGWGKIFFTVAPDGMALPCHAARQLPISFPNVREQSLSKIWYESTGFNHFRGDAWMPEGCRSCPDKDRDFGGCRCQAYMLTGDASNADPVCGKSPYHQFIEQARAESEIDSSLEKLVFRNSRNSKQFTVQQNIPVQNIVDD

SEQ ID NO: 7609 - protein, 91 aa, Acinetobacter baumannii
RMMTTATIILVLVAANINALGTLLLVKFKVISQKKAFSYFTWILFIFFIGLYFKLFGDKVDIDRSEIWLICVIGYSIVFGPEDWGMYDENN

SEQ ID NO: 7610 - protein, 242 aa, Acinetobacter baumannii
SRMTLMQLTEQQQDKLSKVQLEESWKRSLTPFLLSPYMDSLRDFLFQQKQAQKTIYPPSKQIFNALNITPLDHVKVVILGQDPYHGPNQANGLSFSVQRGVALPPSLRNIFHELHTDLGVPVSRHGDLTKWAEQGVLLLNSVLTVEAGQPTSHQKQGWEEFTDAVIDVLNEQREHIVFILWGAYAQRKGQRINREKHLVLTAAHPSPLATNRGGFFGCKVFSKTNQYLKQHGIEPIDWQLDA

SEQ ID NO: 7611 - protein, 320 aa, Acinetobacter baumannii
TMATFQKRNGRVTATVRIKPHPAKSKTFDTLRDAKKWAQETEVRLKNEKLEIFDHIIFKDALIEYRDTVSINKRGFEKERRKINFLLKAMYVDQPLIQVNKDFLTEWREQRLLNVKGATIRREFILLSAFFTWCIDVKRWLSVNPLREIKFPSESPHRERVISDEEIEILLPFLSTEMRYIFLIALQTGMRLSEICNLKWEKIRLSKSYLILDLTKNGRAREVPLSSQAVEIFKSIGPKKQGYVFSITSDDATDEFRDAKLEAGLEGFTFHDSRHTAATKIALKIPLLDLCKMFGWSNPRRAMIYYNPTSSEIAARLSQP

SEQ ID NO: 7612 - protein, 179 aa, Acinetobacter baumannii
LMWTSFLMNHFELFNLPVALDIDLASLKSNFLSLQQQYHPDKAADKDQALIKSSEINQAFKTLSQVDSRAAYLLALKKQDHHLDQSISDFEFLQSALELREQLDEATSSEHLRTLRLEVQQWIDGLVREFKIDYSEEDWAEARDTVRKLRFFQRVLNDIDKAEDQLLDDEDSFDLDDDF

SEQ ID NO: 7613 - protein, 64 aa, Acinetobacter baumannii
HSFAKFTRIELVIMTDSEVLTIQGALKLAKVRIDVVGENCHPRKPISINCPVCFNCSNQGLPCK

SEQ ID NO: 7614 - protein, 112 aa, Acinetobacter baumannii
MSFASLFWAIAAMMQACMLSQFGQKKLQYSWLKSTSRRILYGTTILFLLSSLFWNCSFEGSSVGVLSWFFAIITTAFFFQIIVFYFFRKYFIPIWLMVIVVAIIFSIVEWVP

SEQ ID NO: 7615 - protein, 118 aa, Acinetobacter baumannii
LVLARWCGMSDLETKAKDYKSERDQELNDLRSILETEHGKRFLMRLINRSNYLQPTYGTGAHMSDFAFMEGRREFGVYIIGEITQVDSNAWLDMQRDHFKKTEQKVNHERSDNNYDSN

SEQ ID NO: 7616 - protein, 265 aa, Acinetobacter baumannii
GGSAMNIDLKGKVAVVSGGATLIGKAVVQALVSAGAHVAILDIDAKGKAIAESFNHDVMFIQTDLTSDAAIQQAVADIHQHLGEVSYLVNLACTYLDEGFKSSRQDWLQALDLNLVSTVELSRALYHDLKKQQGSIVNFTSISAKVAQTGRWLYPVSKAAIRQLTQSMAMDFAADGIRVNSVSPGWTWSRVIAEVSGNNREKADSVAADYHLLGRLGHPEEVANVVLFLLSPAASFVTGADYAVDGGYSVMGPEGSQPAIPRLAE

SEQ ID NO: 7617 - protein, 335 aa, Acinetobacter baumannii
NGSAILGVFMNTQIDREKFLENRKKGIGGSDVAAILGFSPYKSPYQLWLDKTGRSEQSEQNESAHFGNLLEDVVAKEFSRRSGMKVQRVKQQLFLEDHPWAIGNIDRAVINPEISGNVRFKDGALTTDQLLECKTASEYMSKLFGEQDTDQIPDYYLTQCLWYLMITGCQVIHLAVLIGGNKFRMYRIERDEDLIKSIFNQVKAFWFNHVLADVPPEPTCFDDVLHRWSKHVIGKQVEATRDHLKLAEELIKVQQAKKDAEAREEAIKLEIATSMQDAEMMISQGKAICTYKAQSSTRIDTKVLKEKEPELFEKYCSTSSTRVFRIATKFKESLI

SEQ ID NO: 7618 - protein, 527 aa, Acinetobacter baumannii
CIDASQPCSSSNGRGVMNLALFPNELIIDNFAGGGGTSTGLEAAFGRAVDIAINHDPKALAMHRANHPDTKHYCESVWDVDPIEATQNQPVGLVWLSPDCKHFSKAKGGKPVEKKIRGLAWIALRWADLTRPRVIMLENVEEFKTWGRLGEDGKPCPKHKGETFRSFVKALRYQGYNVEWRELKACDYGSPTTRKRFFLIARRDGLPIVWPKQTHGDPESKAVLTGKLKPWRTAAECIDWSLPCPSIFTRQKPLAEATLRRIAMGTMRYVIDNPKPFIVKSNHGGDTFRGQAIESPLQAMTSKNGYALAMPVLTECANASSPRCMPANEPLRTICAGVKGGHHALVSAFLAKNYTGVIGSDADKPIHTITSKDHHSIVASHLVKLRNNNIGHRVDEPIHTITSSGAHFAEVRAFLTAFYGNERDGNSIDNPLRTIPTRDRFGLVTVEGQTYQIGDIGFRMLQPHELFKAQGFPDDYIFSYGIDEHGNTVKLTKTEQTRMVGNSVCPQLSEALVRANFSHEKKYQGAA

SEQ ID NO: 7619 - protein, 102 aa, Acinetobacter baumannii
PQPAQTNLFSRSARVANSAQAKKRARQNVKARKHNASLRSMVRTYIKRTLSAIAGGDYAVATEAYKKAVPVIDRMADKGIIHKNKAARHKSRLNAQVKALAN

SEQ ID NO: 7620 - protein, 567 aa, Acinetobacter baumannii
SKTADFIRYIMTESFAALFEESELNLNVEKGAVIQGVVVNIDSDWVTVDTGLKSEGIVDRAEFLNEQRELEVQVGDTVDVVVEALDNGMGQTVLSREKAKRAETWTKLEKIFEDGEIVTGVISGKVKGGFTVDIGPVRAFLPGSLVDTRPIRDTTHLEGKELEFKVIKLDAKRNNVVVSRRAVMEAESSADREALLAQLEEGQTVTGTIKNLTDYGAFVDLGGIDGLLHITDMAWKRIKHPSEVVEVGQEVTVKVLKFDRERNRVSLGLKQLGEDPWLAIMSRYPKGSIVKARVTNLTDYGCFAEIAEGVEGLVHVSEMDHTNKNIHPSKVVQIGDEVDVMVLEVDEERRRISLGIKQTRANPWEEFAKSHEKGEKVSGTIKSITDFGIFIGLNGGIDGLVHLSDISWNEQGEEAIRRYKKGDTVEAVILSVDAEGNRISLGIKQLNSDPFNDFLAANERGALVKGTVTAVDARGATVKLADEVEATLKASEINRDRVEDATKFLEVGQEVEAKIINVDRKSRSINLSIKAKDEAEEKEAVANLRTASASQDNGPKTIGDLIKAQMK

SEQ ID NO: 7621 - protein, 313 aa, Acinetobacter baumannii
CGIAFASYKLHAEKALLHSNHLYLTNYTFHNLYVALYSWVYIAAKNDKKVNIMETDTKIKKLALACSVLSIGLVFNISAKAESVTVYAAASLTNAINDLEKIYEKQNKVEVKTSYAGSSTLAKQIEAGAPADIFISADTQWMDYLQNKKRVAANDRINLLGNRLVLITPKGQSLNIKLDKATDPNKVFTGKICTGDTKSVPVGKYAKQAFTNLGWWNRIEPKLVETEDVRAALNFVARGECQVGIVYATDAAISKDVKVAGIFPENTHSPIIYPVGIIKKNSNSAKFYQFLQSNQAKAVFKKYGFSVLAPVKP

SEQ ID NO: 7622 - protein, 554 aa, Acinetobacter baumannii
SVTALYLDLKIGECMTKTTDDEILALLAEMDESEIEQYLLTLNEDEQAEIAKLLADAPIWFPLEGPQMAAYLSQADVIGYGGAAGGGKTDLIVGSFLTVHKRSLVVRREKAQTDGIVQRCEEILGHKNGYNSQKSFWNLGNGRLIEFGGLDNLGDEKRWQGRAHDFKALDEATEIRESQARFVMGWNRSSDPTIKSKCLMTFNPPTTAEGRWVIDYFAPWIKKGHPNPAKPGELRWFAMVKGKEQEVESNKPFVLIDDQIVYDFDPKDYKPEHIIKPKSRTFIPARVTDNKYYMETGYMSTLQALPEPLRSQMLYGDFGAGIEDDPWQVIPTAWVEAAQARWKPEDEMRLMYKGVFPMDSYGLDVARGGKDNTIGYARHGFWYNKANVLEGIQSKDGPASASFAVSHVRDHAPIHVDVIGVGASTYDFLKQSGIHVVPVDVRNAATSFDRSGQLSFYNLRSQLWWQFRESLDPAYGSTVALPPEPELLADLTAPRWSLQGTNIKVESREDIVKRIGRSPDYGSAIINAQIDTPKRHIMQTINASAARRDYDPYA

SEQ ID NO: 7623 - protein, 232 aa, Acinetobacter baumannii
PLQAKTRALLQLWPITLMTRAPLLRGGLMQIKLRHSWPQKPQQKSLKAKISKGDLKMDTIETLALQTINAENPREIRNLLGQFATGVTVITTRGKDGRKIGMTANSFSSLSLDPPLILWSLSKTAPSLPDFVEAEYFAIHMLAQEHHQLSGHFARGAEDKFAGIAHQQCNAGVPILTDALATLVCRNVNQYEGGDHLIFIGQIEQYQQRQGEPLVFHAGKYRIAAEHPELAH

SEQ ID NO: 7624 - protein, 1159 aa, Acinetobacter baumannii
LIKAIYMFQQEISQLNLQQLKAGEKRWVGSLLGSSAALLLKEIATQHSSLLVLVARNNQHVAQLESELEFYGVKPTIFPDWEILPYDRLSPHQDIVSERLAILSNMPQQGVLLISASTLAQRVAPYSWVLGEHFDIKVGQKFDLEQQKLRLVQAGYHLVDTVYDHGEFAVRGSIMDIFASGQESPIRIDLFDDEIDSLKFFDPETQRTTTTLKSFTVLPAKEFPLKEGRSVFRDRYSEFFPTANPKKNPIYQDVLDGIASPGIEFYLPLFFDKEQMQTQSMFTTYLPKNCIVITTNDIDTDLTNFWKEVMRRYEDRRHNMDQPILAPEELFISPNHLLSALNQFPRMLVSAETIEEKAGALNLKTEQPPKLPVDPKKEKPFSAVKKYIDEANHPVLLVAESAGRRESLKDALRSSLGEIPNVENFEQFQISQFAIAITNAPLDRGLLLTDQLTVISENQLYEHRVVQRRRKRQQEVSEEFLIRSLTELSIGAPVVHIDHGVGRYAGLITLAIEGQDYEFLQLDYAEDAKVYVPVTNLHLISRYSGGDPDLAPLHKIGTDAWSKAKRKALEQIHDVAAELLHIQARRQSKPGFAFELDQSLYMQFASGFAYEETLDQANAIEATLYDMQQAKPMDRLVCGDVGFGKTEVAMRAAFVAVQNGKQVAVLVPTTLLAQQHYESFKDRFADWPVRIEVLSRFGSNKTHLKNIEDLANGKVDIVVGTHKLLQENVQFKDLGLMVVDEEHRFGVRDKERIKALRADVDMLTLTATPIPRTLNMAFSGMRDLSIIATPPARRLAVKTFVQEHTDASIKEAILRELLRGGQVYFLHNEVETIERAAENIRVLVPEARVAVAHGQMRERELEQVMQQFYHKEYNVLVCSTIIETGIDVPNANTILIERADKLGLAQLHQLRGRVGRSHHQAYAYLLVPSIKHLKGDAEKRLDAIQRASTLGAGFMLATEDLEIRGAGELLGEQQSGSMQAIGYSLYMEMLEKATKAIQQGKTPNFDAPLSLTAEINLHIPALIPDDYLGDVHQRLLFYKRISNTDTQEKLDNIRMELIDRFGIPPQSVKHLFSVHQIRLKAEHLSITKIDINTQGGNIEFSPDTPVQAISIIQLMQKNPTYYRMEGGQRLKVMVQLEEYEKRIQFINDLLQKLMSELHA

SEQ ID NO: 7625 - protein, 393 aa, Acinetobacter baumannii
IALANRKLKIGIVVGEVSGDTLGVKLMRSFREQGIDAEFEGIGGPQMIAEGFNSYYPMETLSVMGIVEVLKDLKKLFAVRDGLINQWTQHPVDIFIGIDAPDFNLRLSKSIKEKNLPIKTVQYVSPSVWAWRQGRVHGIKQSIDLVLCLFPFEKVFYEQYEVPAAFVGHPLAKQLPLENPIQIAKQELGVDENQKHIALLPGSRKGEVERLLPMLLGAANILHTKYPDIQFLIPAINDARKQQIEQGVEQLAPQLKAKIHILENTDSESKIGRMVMNASDIIALASGTATLEAMLMHRPMVTFYKLHWLTYLIAKFLVKIPYYSLPNIIAGKKVIEELIQADATPENLAAEIEKLMNVETAQIQVMQHLTMHKQLISGNTEDPVQAILQYLNS

SEQ ID NO: 7626 - protein, 286 aa, Acinetobacter baumannii
FCMAYQTLEQLQQSKAKLHETVVLDENMQLAFWSNQQDRVSVCSDHHTLSLYIQDGYESYQKTPAGWKNGGGPGRFCLLPEHQESTWDIRGGLKFVHLYYTDQHLRDVAEKIWDKEPNQIELNEVVFNDDERIRALYQFFLLDCDWQDSSNHLQMSTTASLLLNHLIRKYSSVQWQQPTIKGGLAPHKLKYIQEWIEDHLDQALTLSDLANIVNLSEYHFAHMFKQSMNMAPHQYVMQRRLTKAKGLIQSSQLSLQDIALVCGFSSASHLSHRFKQFYGMSPSQLR

SEQ ID NO: 7627 - protein, 321 aa, Acinetobacter baumannii
FIMAVSYKHQQGVALLTILIMVALATILAASIAKHQNNTMENTAYLIRQNQSLLYAKSAEAFFSELLIQDANNAGGVDHLKETWAQPMPPFPIEDGLVSGRLLDESGKFNLNNLTNGEGIVNEDAKSWFERLLVRVGLPAELSQAVIDWQDPNEEPTGPMGAESSYYEGLDPGYMAANTKFHRIEELKLVRGFDGKKFDLIAPYISALPENSKLNINTASPLVLASMDEKLDIGAIEKELQTRQQNLKFFQNVDELWQLNAFSAVDSQKKNQVNSLIDVKSSFFQAQIEVVLNNRKRQFTSALMRKDKQVYVYSRSMAPFN

SEQ ID NO: 7628 - protein, 166 aa, Acinetobacter baumannii
GGPADAFPSSPVGVRQYRVEMLKSGIELYEFKPVLERRRRTWYEIVTGSVIPAKGKNKSSLHAKFFDVDGKVFIGSFNFDPRSTYLNTEVGLVIESSQLQTQISVMLDQHLPQVAYQLKLNSQGQITWLDYQANGQVIEYDKDPGTSRFQRTMIKAVSYLPIEWMM

SEQ ID NO: 7629 - protein, 60 aa, Acinetobacter baumannii
MFRANRRSLHLGVSKGKFCKVTILLSEVVQSNALPCEPVFYISILNSHASKTKYFVLIKK

SEQ ID NO: 7630 - protein, 238 aa, Acinetobacter baumannii
LKHLLLRESSMTVQIITIDGPSGSGKGTLAAKLAAYYQFHLLDSGALYRLLGLSLHKHDLLEKLDSHLDECVNYARQLNIKFETSAEGTLVFLDGEDVTQTIRTERVGEYASKVAAIPELRQALFERQRAFAQTPGLVADGRDMATSIFPEANAKIYLTASAESRAERRVKQLQGMGLDAKINDILANIQARDKRDMEREVAPLKPAADAYIIDSSELTIDQVFKLMVDYVNSRTVSN

SEQ ID NO: 7631 - protein, 307 aa, Acinetobacter baumannii
DINFMHIYILGSAAGGGFPQWNCNCPNCHGVRTGTINAKVRTQSSIAISENGVDWILLNASPDIRQQLFDFKAAQPARKLRDTGITNVILMDSQLDHTTGLLTLREGCPMNVWCTEMVYQDLTSGFPVFNMLKHWNGGLQYHQIDPKQAFKINGFDNLEFLPLIIQSAAPPYSPHRHDPHEGDNIALIIKDHKTQKQLFYAPGLGKIDDQIMQIMQDSDCVMIDGTLWTDDEMQQTGVGKKTGREMGHLYISGEGGSLSYLNQLSTPKKVLIHINNTNPILNEDSAQFAELKANGVEVAFDGMQIEL

SEQ ID NO: 7632 - protein, 399 aa, Acinetobacter baumannii
RELYMNFQRMTDLNLAGKRVLIREDLNVPVKNGVITSDARLRAALPTIKAALEKGAAVMVFSHLGRPVEGEPKPEQSLAPVAAYLTEALGQEVKLFTDYLDGVEVEAGQVVLLENVRFNPGEKKNNPELAQKYAALCDVFVMDAFGTAHRAEASTEGVARFAPVAAAGPLLAAELDALGRAMQTPEKPMVAIVAGSKVSTKLDVLNSLSGICDQLIVGGGIANTFLAAAGYNVGKSLYEADLVETAKQIAAKVSVPLPTDVVVADASQINFEDFLGSLAAAQAVIKKVEDVTANDMILDVGPETAKAFANILTTSKTILWNGPVGVFEVDQFGEGTKALSLAVAQSDAFSIAGGGDTLAAIDKYNVADQIGYISTGGGAFLEFVEGKTLPAVAVLLERA

SEQ ID NO: 7633 - protein, 67 aa, Acinetobacter baumannii
ILIYLYFNTFDQSIKLNKYLNILNFRTSIHSIYAHIPTIISRLPSFLLCKKCIIALINALEVKHFEF

SEQ ID NO: 7634 - protein, 234 aa, Acinetobacter baumannii
IFVYQINSKLGHIFLIYILGEENMWELVKAGGWLMLPLILCSILTVAIIIERFVRLRRSQVLPKVLMNDGSADISVVITNLEQDTNAQSTALGNILKAGFEHQEHGEQFARAQMEAMASQEISYLEKNINFLGTLSAIAPLLGLLGTVVGIIESFLVIDFGSAGSPSLMIPGISKALITTAVGMLIAIPALISYRYFQRVVQDYIAELEQQSTLFHASLFYKRSSIMQEHRRVG

SEQ ID NO: 7635 - protein, 175 aa, Acinetobacter baumannii
LCYYKNILWLNNTSSLSSDQELRSMDNANIETQAEEQGEKNKSKSKSSRKSALDFRKYTKQIWLAGLGAFSRAEEEGSKLFDSLVKVGEELESKTGDLADTTVGKVTEKAKESVSDTKDKVEKILDTSVNHSLNRIGLVTPKDLQHIEQLLVQLHIKVDALIEENQKLKAKLNEK

SEQ ID NO: 7636 - protein, 600 aa, Acinetobacter baumannii
KTNYVGMNLKLKFFKLVILSLAITSVPCAYAITPAQPNKILHVAYEAPDDGFDMVKTTNFYSASIAEAIFEPLLKYDYLARPLQLVPNTVESLPKVEQDGKVYIFKIKPGIYFTNDPAFKGKRRELVAEDYVYTIKRILDPKNRAPSVSFIDGKLQGADTVVAQAKKTGKFDYAAPIAGVKALDRYTLQFTLTRQDFNFPYILAYITFGAVAKEVVDYYGDRIGMHPVGTGPYMLSKYVPRSKVELVANPDYRGFVWNFKSTGTPWDNQLVKEMSGKKMPQVGKVVVSIIEEEQSRWLAFQSGQLDFDKLTANAVPQALDGNQLKASFKKRGIKHYPNKDPEITYTMMNMRDPVIGGFSPEKIALRRAITLSYNQKESIQQAYKSQAVRSQMFIPEGVNGYNPKYKSSVGYNPLLANKLLDYYGYKKAADGYRTLPNGKPLILKINTENSSASVIHSELWKKNLDAIGIRADFKVSNFADNLKAATQCKYMIWSGAWIADYPEGDNFAQLLYGPNAGQGNHACYQSKTYDALYTQAIHLPPQQRLPYYEKLNRQIEADNPWIIHVTRIRNWLVQPQVQGFKAHPMMNTNWQYLDMTPIKK

SEQ ID NO: 7637 - protein, 309 aa, Acinetobacter baumannii
QSIYYYMQSISLIIQIFLVLAFGYFLGPKLSLNIRHFIFKILPYFSYILLTSVALELTLALDQIDNPSTILPPALLIALTTSLGSFFTCLFAYTIFDKESVKGKISLQLFMNALKNIAKAFLALTIGVILGILLTQLHTHIPFNSWYLLLLFIFLIGIELAFTHFNRTWLSWKILIVPLAAFIGSCLAGFLNYSLLGHEFTLNEILALGQGYGWYSMSGILFTQLHSAELGGIALLTDLFREIVAILLMYTMGWRFPRPAISSAGATSMDVTLAMVKQSCGTHYVPHAMMSGLLLSLLAPLLITVFLNF

SEQ ID NO: 7638 - protein, 170 aa, Acinetobacter baumannii
TFTYEAIGPRGRNDMRRNNIEIRKPTERDIRILVENLRPADQEELKAYFSDNYQWIVKTCVKGSRDSWAVVVNGKLLFICGVGITSLIGKVGCPWLLGTTHISKYPIEFIKQTRNILKEMLLDHDLLRNHVYIKNDAAIRFLKHLGFKLDAPEVHGINGEFFYPFSMVAA

SEQ ID NO: 7639 - protein, 150 aa, Acinetobacter baumannii
LCYYYYSYAQEGTFREPSNMTVTIPHDIQSSDCQRVSQVLARVGEKWSILIVMTLASHPHRFSEIKRRINGISQRMLTLCLRGLERDGLVKRTVYPVVPPHVEYELTPLGHSLTEPVIALGQWAQQHIADIDAARAAFDAAQEKPITLDT

SEQ ID NO: 7640 - protein, 200 aa, Acinetobacter baumannii
VKHYQCTCRSNVPFRKAIISRNVNQNTRQPNQGSRITWFKPRNVTPTFESSQHFKNEGDSMTDAEIERSNFELFELSKRPCAKRESLFERFDSNGLGESEQHYVGKYVDSYMQEKWELWEKAKAQAVPVTHTHSVTLTCAELKEAYDFGAPDESQEQMTDLVTIGWHEDGHSGAGYYAYMTECEDEGSIKLGESESGAEG

SEQ ID NO: 7641 - protein, 358 aa, Acinetobacter baumannii
MISYEKTDMNHGTFPVFDGHNDVLTRLWLSDHKNPAQAFIQEGLAGHLDLKRCQQAGFVGGMFAIFLPPFHYVKQHHPNKLFDQDASDFTQQQIEHICLAQLDLAKQLAEYSNDIQICTTVQDIQHCLTQQKLAIVLHMEGAEALQHNPDLLDVFYDAGLRSIGPLWNRPSRFGHGLNVKFPHSPDTGAGLTNEGKAFIKRCADKKMVIDVSHMNERAFWDTANILQQPIVATHSNVHALCPQARNLTDNQLKAIKDSKGIVGLNFDVAFFRKDGQRDANTSIEVLLEHLEYLIDQMGENHVGFGSDFDGALISHEIEDVRGLHLLIEAMQKRHYSNEIIEKICFSNWLTVLNRILGK

SEQ ID NO: 7642 - protein, 319 aa, Acinetobacter baumannii
GVSYCTWLGSLVQRLYMIVRDKSNVFKLLFAWKGTILPKVLPALSFVVLISACVVWLSYYHWIQIPTVPAIGFTIFGVILSICTGFRNNACYDRWWEGRKLWGALIANARHIVRDSHVLSNEQREHLIHQVLTFSNLLRDRLRQQTVEPTKFLEHAYLNNSSLNYLNEHINAPQFVLENIQKDLVKALKDGEISDIIYGTLTRHIVELGNIQAGCDRIAGTPLPYSYSVLLHRAVYCFCFILPFSLEAALGIWTPLIVGLIAYMFLGLDALSAQIEEPFGLQENDLPLDSIVRLIERESLSSLGQPLPPIIEAQDNNLL

SEQ ID NO: 7643 - protein, 138 aa, Acinetobacter baumannii
YMAYDDQNIFAKILRGELPAIKLYEDDQVLAFMDIMPQADGHALVIPKTPAVTLLDLPPEAAAYTIQIVQKIAKAMETALNLDGIVLMQLSGAAAGQTVPHVHFHLIPTNVHQLGKHAAQLGDQDKIKALAEKIKTAL

SEQ ID NO: 7644 - protein, 418 aa, Acinetobacter baumannii
LYRYIEKGNMTMNAPVNVQQELMPVPASMREIDRKRYLWMISPALPVIGLGILAGYHFGPRPLKKVFALGGPLLLHVVIPAIDTIIGKDARNPTDEEIKLLEKDPYYSRLVKSFIPLQYAANIYACYLTSRKDTSFIDKILLGISMGAINGIAINTAHELSHKHDRIDHILSHLALVPTGYNHFRIEHPYGHHKRAATPEDPASSRMGETFYEFWPRTVIGSFKSAIEIEKNRLKRKGKEFWSLDNELLQGWGMSAAFHASMVGIFGKGTIPYLATQAFYGISLFEIINYIEHYGLLRQKKENGQYERTMPEHSWNNNNVVTNLFLYQLQRHSDHHAYPTRPFQALRHFDEAPELPSGYASMLLPAMIPSWWFKMMDKRVFDHYKGDLNKANISPKRRAKIFKKFGVVDKSLEATQAE

SEQ ID NO: 7645 - protein, 97 aa, Acinetobacter baumannii
MSHLKKQENFNFTYSRIFFICLAAYCYSSWLSLVLAKWLPFAKAENVYFSVFISFIFFIFYIVFTSSILSKLWFWMINSLGVALLVSYWLLAKWGVA

SEQ ID NO: 7646 - protein, 433 aa, Acinetobacter baumannii
KKFQIEDKAITMSGVDTMAGQTIQIKTASGKQFSAYLATPETGKGPGVVLCQEIFGVNAAMREKADFLAEEGYTVLVPDLFWRVAPNIELGYTPDDFQKAFELYQQYDENLGVEDIQASLAFLKTRPECDTATGLGVVGYCLGGKLAYLAGCRLSEVACAVGYYGVGIEKALDELANVKGRLVLHIAELDQFTPPDARQAIVDAVNQYSNVQAYVYEDVDHAFARPKSNHYHKPSARFAHERTVTALHETIGPKYDLVTLWEEHIRHEFDTRDVPATMATMVAEPYVNHIPTLTGGVGQSQLARFYQYHFVHQNPKDMKITSISRTVGSTQVVDEFIMSFTHDAEIDWLLPGVKPTGKYVEIPMLGVIQFRGSKLCHEHIYWDQASVLVQIGLLDPTGLPVAGVETARKLLDEDLPSNTLMPSWSSSEGKPVN

SEQ ID NO: 7647 - protein, 264 aa, Acinetobacter baumannii
SPVHRNCAHTGGFNMNAMVNLLNGFKLAEGFCEIHQVQKVQAGPHQICPSCAINHVHDSKQGEQARVDQMVRDKHFGGAMLPERHAQSAFDNYKTLTHAQANTLTECIQYAQALLAGDKSNFIMVGSTGTGKTHLGCATAKTLLKKGLYVRYITSEELAQRVMNAWDKDTKDQSEASVIYEFTTYDLLILDEYGLHDRGTRLEIIHKVLTARYDRKKPTMLISNFSMNKLKADLGDRLWSRFQHDGLRTVECNWSDARVGGAYV

SEQ ID NO: 7648 - protein, 253 aa, Acinetobacter baumannii
NMTQTPEALTTEQFKQAIIDKGQYYHIYHPFHVMMYEGKATQQQIQAWVANRYYYQINIPLKDAAIMANCPDQRVRQEWIQRMIDQDGEYPDGGGREAWLRLAEAVGLSREQVISEELVLPGVRFAVDAYVNFARRASWREAASSSLTELFAPQIHQSRLESWPQHYPWIDDKGYEYFRSRLSQARRDVEHGLTITLDSFTTHEQQQRMLEILQFKLDILWSILDALTLAYVHNEAPYHSVTQERVWHKGLFK

SEQ ID NO: 7649 - protein, 747 aa, Acinetobacter baumannii
KSAQHLFLALQIMHGMAGSYSMERRSLNLHFMTCSKTALASSIALITSVVYANEAEVSQLPTITVNATQNSDALYTSKKVSLSGFQTGDVKKVPASITTITSERIADQHAKTLTDVIKNDSSLGDGYAAIGYYPNFVARGFALDLGSSYLINGHTIRGEQNVALENKEQVEILKGISAIQSGMSTPGGVINYVTKRPADVKNITVDANSEGGYTLATDVGGFVNDSFGYRINLAHESIHPNVDHANGKREFGSVALDWKINERSKLLFDIEAQHQSQRSVPGYQLLDGQEVPTNVDQDRLLGYQSWSKPVVNNSVNTSLKYQYAFNDQWNGSLSASQSRVVIDDNSAFPWGCYSSICEVTGLGNTFDKHGNYDIYDFRSPDDTRITNQFAAGLNGQFNTGNIQHQVAFELQRTYKTLKHHTPLNVAVGTGNIYEDTVVDYSPSSESPGDRYKALESDQTALTVSDRVQFNDQWSTLLGGKLIHLDEQAYNSDGQQSRDTDLNKFLPQLALMYSPISTTNLYASYAKGLSDGGEAPWFANNALEVLSPKNSEQYEVGVKQQIRNFLVTAAIFDLKQDNQYSKVNADRTFDFVEQGEQHNQGIELGLTGALTDTLDVSSGVTYTKSRLVDIDTDNYKGHQTQNVPKVRATAQLSYKVPSVEGLRLLSGMQYSSSKYANKEGTAKVGGYSVFNIGAAYKTNFAGHDTTFRFNIDNLFNKKYWRDVGAFMGDDYLFLGNPRTAQFSTTFSF

SEQ ID NO: 7650 - protein, 759 aa, Acinetobacter baumannii
ARNHIRSKQVLFKMTPCCLAISAIFAQQAYAETVTQTAEVSENATQKPVAQLQKIVVTATRTPKNIAEIAGTVQSIDQKQIIQQATAGRKVADILAQLVPSLASSSGTTSNYGQTMRGRNVLVMIDGVSQTGSRDVSRQLNSISPGMIERIEVISGATSIYGSGATGGIINIITKRADTSKPLSFETKVGITSSDTFRSDGLAYEVGQSVSFNKGNMDGFLGANFTSRGSQFDGNGDRISLSPWQGSTMDTDTIDVNGRLNFNLNDTQTLSFGAQYYKDKQDTDYGPDYSYLPTTSKSNDATTPTYKAIKGLKLSNPLFTERYAVNSQYQNQDFLGQILNVEAYYRNEKSRFFPYGLSNKSVTSVNQSQSEIEVAGLRSTMQTDLNIANRDMKITYGLDYDWEKDKQFVDILATQYPYLVYTPTGQRKGYGPNTEIQNIGAFVQSDYAVTDKLNLQAGIRYQYIQADTDAYIPSRETTMVPAGSTHDDKPLFNLGAVYKLTDAQQVYANFSQGFSFPDVQRMLRDVSTYTVSTANLQPITVNSYELGWRLNQDDGLNLGLTGFYNTSDKTVQFNNRAAKVVDTDQRVYGAEATISYPFMENYKVGGTLGYTRGQYKDVANKWHELNSFTVAPVKGTLFAEWDNNEGYGVRVQMQAIKGTNKAYKDDRELAAFATTQDEAFRKAVENDANSAAQIKGYTTMDVLAHFPAWKGRVDFGVYNVWNRQYRTVFAQQAAVSNANPLLAIPAEGRTYGLSYTFNY

SEQ ID NO: 7651 - protein, 254 aa, Acinetobacter baumannii
PNNHFKNCLSTVSGVTMGMTFTDIENKSAKRLIGIAAVIFLHLLVAYILMSGLANNIQKPAEKPVELQIIQDIKPPPPPKPEEPKPKEKPPEPPKMVEKVAKVPEPPKEVEKVATPVQKTTPVAQTTKVATPAPAAPSTPSPSPVAAPAPVAAAAPALKPAGVTRGVSEGSAGCEKPEYPREALMNEEQGTVRIRVLVDTSGKVIDAKVKKSSGSKTLDKAATKAYSLCTFKPAMKDGVPQQDWYEIEYPFVIE

SEQ ID NO: 7652 - protein, 77 aa, Acinetobacter baumannii
GLNHMTNLTEHKCKNKCPEFKGEQCNHCLVQPVEQRKIEDMGDDRHIENHVSKNCHVTSCDVLMHLNRAHQAMGEVS

SEQ ID NO: 7653 - protein, 90 aa, Acinetobacter baumannii
VLNHQLWKIVMNLKLTFAALLIVPMMLTACAKKEEATHAGQDAASTAVADKVTPEQQAAIDALDKPVLDEKNTDVVEGSVSSETAASETH

SEQ ID NO: 7654 - protein, 147 aa, Acinetobacter baumannii
WVDHNMKFKRSQVEDIHINLTPMIDCLLFILVFLLLSTTFNQPSRINLTLPDAQGVPPKQYDHKIEVVVDSSGHYAVNGQALSTKDVADLSTAIKQIAQERRDFMFIIAADAKASHQDVIRVMDVAGQLGFVNINISTKVPSRGFSE

SEQ ID NO: 7655 - protein, 73 aa, Acinetobacter baumannii
ISFLAINFYLSQTYTVKIKLKNFNSFHTLAKQTFNQPLLIYNICCALYALINSLFLIYRNKVFYYNQSSCKLI

SEQ ID NO: 7656 - protein, 580 aa, Acinetobacter baumannii
EEIQMSEQEKKTPLLHIENLRVSFKGEDKQYIETVKGISFDIPTNTTVALVGESGSGKSVTSLATMGLLPVGQSKIDEKSKIIFEGKDLLGLSRTEMRKICGKDIAMIFQEPMSSLNPVFTVGNQIAEVLCLHMGMSRKQARQRVLELLKEVGIPSPETKIDAYPNQLSGGQQQRVMIAMAIACEPKLLIADEPTTALDVTIQKQIIDLLESLRQRRQMSMLFITHDLALVGEIADQMIVMRHGEIREQGTAEQVLEQPKDVYTRALLYCRPQMSQRPYRLPVTSDFMRQENNILVEQSFDVSEIPERKRGLNGDEQIILEVKDLKKSFYSRKGLFGKEEFQAVKGVSFKLAKGKTLGLVGESGSGKTTVGLLLMRLHQASGGQALIEGKDILSLTEKEFAKYQRKIQIIFQNPYASLNPRFTIGQILLEPMQIHGIGKDDAERKQIALGLLERVNLPEQAYYRYPHEFSGGQRQRIAIARCLTLKPEILICDESVSALDVSVQAQVLNLLQDLQDEFGLSYIFISHDLSVVKYISDQVMVMNHGEVVEIANSDELYAHPQHDYTKRLLQAIPQGIQHVS

SEQ ID NO: 7657 - protein, 61 aa, Acinetobacter baumannii
MSDQVLVVAIKKGFYHGIRDVGTEFYVPADLVNPKVKTWFKPVEEKPKASGRGATGSTQAE

SEQ ID NO: 7658 - protein, 248 aa, Acinetobacter baumannii
AVSQLPQDPKNHKPLYDQLRELILNKIVNGEYAVLSQIPSENEFAEQFGVSRITVRQALNQLQLEGYIFKVPGKGTFVSKPKTFQNISSLQGFAEAMSSAGHEILNRVISAELKQVPMHVVPKLKLPVKANVYEIQRVRLLNRQPVSYELTYLPEHIGLKLKEKAIDLRTTDIFKALEQECDIPLGHADLSIDATVADEELAALLQVEIGTPVLRVERLTHDANGQPIDYEYLYFSGDTFQYRLRIHR

SEQ ID NO: 7659 - protein, 451 aa, Acinetobacter baumannii
EGIHMKTIDANTIINREKLSPLQWMVFILGFFVFFCDGLDTGIIGFVAPALLDDWGITKPQLAPVLSAALVGMSIGAIISGPLADKFGRKGVIVFTSLLFSIFTILCGFANSTQDLMIYRFITGVGLGAAMPNISTIVSEYMPVKRKAFLTGLAGCGFMLGISCGGVLSAYLLESYGWAKVIIIGGSIPLILVIALLLKLPESTQYLITRHQQDKAQRILENIQGYSFQKPIKLVLTQAETASDENPVKVVLGKYLWGSSMLWLCCFTSLLVFYLLTSWMPTILKTAGFSTQQFSLIAAIFPFGGVIGATIMGWYMDKLNPTTVIKYSYLIAFVLFIIAGLVSSNIFLLGLTIFLIGALLAGAQSSLLPLAAMFYPAVCRAVGVSWMHGIGRIGAILGAFFGSLIFTFNLSLSGIFFILAIPTFISFIALSLKVIYEKSKHKQVLKLEESL

SEQ ID NO: 7660 - protein, 850 aa, Acinetobacter baumannii
NLKQAEIFEGLSVATYKLFLYDATIINCELAYLVNETMKHQFKFNPLATAIFTLLCSGSIQSSYAESAGVVSNIDNNQLKASIKEAYPGQEFFQQYYVDKSAPEAQLRNNKYLSSAFCQGTWITPINPETKALDADKATSVVTADYGHYNPAGDSVLEGNVVIDQEGRTVRADKVTIDKTQTFAHAQGRVQLAQGGLLSQSDEIDYNLKTQTGNLDNSFYISEQQHAHGHAGKIERTSPNVMVLNDATYTTCPPGQKPGWKIQANKIELNQETGRGVTRGTKLYVKDVPVLAVPYFNFPIDDRRTTGILNPQFGFSNDGGIELSVPVYLNLAPNYDATITPRYLADRGAMLQGEFRYLTDGFGAGQIWGGILPSDKEYDDKDRKDFHFLHNWDINDQWSTNLEYNYASDKDYFSDLDSSPNSKTDLNLRRAWELNYQHGIPGLKAQLKVEDFQTLDPEVKDVNKPYARLPQFLLNYVTGNPLGLQYEFNNDTAYFKKSINDDSAQESSGTRIYNQFATRYNYRTPAAFVIPEVSVRSIQTFYDKDSIASQGLDGGSENKSVVVPQFTLDTGLNFEREGKYLQTLTPRAFYAYAPYKNQDGYPNFDSTTASISYDQLFNPYRFYGHDRLEDNNFLSLGVSYSLFDTVGLERLRASVGQSYYFEDRRVTLKQQDEIDTERNTGPVVSLSSQLNQNFTIAANSAWMSNGDNAQRDFQLYYTGDKGNLYNLGYFYRKDIPGRQDTYDQVVASFIQPIKDNWRIMGHVQYDMDNDVARELLLGVNYESCCWGISVYGRSYYNDLDDPKSPDVSEKRAIMAEITLKGLGGLNNKLASLLENRVLGFNKINQSWTQR

SEQ ID NO: 7661 - protein, 78 aa, Acinetobacter baumannii
QVRQMKRLLLVLATGFGLDGCASLTQKADENYITKSPVTPVNTAFNATKVLEHGIFTEQDIADMPEHSSINSHYKISF

SEQ ID NO: 7662 - protein, 367 aa, Acinetobacter baumannii
GVGHMAGNSIGQLFRVTTCGESHGVGLMAIVDGVPPGLALTEEDLQKDLDRRKPGTSKFATQRKEPDQVEIISGVFEGKTTGTPIGLLIRNTDQKSKDYGNIAQTFRPGHADYTYTQKYGFRDYRGGGRSSARETAMRVAAGAIAKKYLAEKFGVLIRGHVTQIGNEVAEKLDWNEVPNNPFFCGDVDAVPRFEALVTSLREQGTSCGAKLEILAEKVPVGWGEPVFDRLDADIAHAMMSINAVKGVEIGDGFAVAGQFGHETRDELASHGFLANHAGGILGGISSGQTIRVAIALKPTASITTPGKTINLNREDTDVLTKGRHDPCVGVRATPIAEAMLAIVLMDHFLRHRAQNADVVPPFAPIEP

SEQ ID NO: 7663 - protein, 263 aa, Acinetobacter baumannii
TYLHQDLLQGGDLMSLSGKQQRFVDEYLIDRNGAQAYIRAGYKVKNEDVAAVMASRLLRIDKVKEAIEKGEKELAERNKITQDKVLNRLWEMATADPNELIRYVRVNCRYCWGVDHYYQWTKGEYHNACYNALVNQKPKPDCDGGFGFNKTRAPNPECPECQGEGNGYVTVADTTRVSEQAKMLYAGIKESQHGIEIKMNDQVAALIKAGQHIGMFKERVEHSNDPENPLTDTKASSRKLAALAKLKKAKAKADKAKDTDDEK

SEQ ID NO: 7664 - protein, 341 aa, Acinetobacter baumannii
ILLQMNTQREQLIHTWLTSVLENDQFQIAYLAGDASFRRYARIQLQNKTYMLMDAPPEKEDCVPFVTIDEFFAGHGVRVPQIVAKDLNQGFLLLEDFGDVLLSTLLNDETVDQYYEQSFKQLIHLQSINGVEHFPVYSYEKLLSEMQLLTDWMLPSLDIHPTAEQKKTIDDAFDFLAQAALAQPQVIVHRDFHSRNLMKIANEEELGVIDFQDAVIGADTYDLISITRDAYVQWNAERVYQWFKVFYELLPASAKQNRSFDQFKRDADLMAIQRHIKILGIFVRLFERDGKSGYLKDLPRVMWYLLEESRGYHELDDFMAFIHSSVMPKFIEKYGPYEVAA

SEQ ID NO: 7665 - protein, 173 aa, Acinetobacter baumannii
FMLQLILGGARSGKSRLAEQTAISMQLAVTYVATAQALDPEMQSRIVHHQNQRPAHWSLVEEPLFLAKTLQEIDRPNQIILVDCLTLWLTNLLLLEDQNIQQFECEQLLRVLPTLQSEIILVSNETGLGVVPLGEISRRFVDEAGRLHQALGQIADKVVFCVAGFPMILKGEK

SEQ ID NO: 7666 - protein, 103 aa, Acinetobacter baumannii
FEMHCDIYRSSKKDEMYIYIARPNYPDETEQADPFEKVPEAVLQAFGRATFVMHLELAPTRKLARVNVLHVLDSLQTKGFFIQMPPEGLINPNAVEPEGLRGA

SEQ ID NO: 7667 - protein, 616 aa, Acinetobacter baumannii
LMTQMANRLTMNISISRAIPSSTVYVFIVNSSDKNKDFTMETKYLEFDIVVIGGGTAGPMAAIKAKQENPNLKVLLIEKANVKRSGAISMGMDGLNNAVIPGYATPEQYTKEITIANDGVVNQTTVYAYAKHSFTTIQQLDQWGIKFEKDETGEFAVKKVHHMGAYVLPMPEGHDVKKVLYRQLKRAQVKINNRIVTTKLLKNEQGAINGVLGFDCRSGDFYVIKTKAAILCCGAAGRLGLPASGYLMGTYENPTNAGDGYAMAYHAGAELANLECFQINPLIKDYNGPACAYVTGPLGGYTANSKGERFIECDYWSGQMMWEFYQELESGNGPVYLKVDHLAEETIQTIEEILHTNERPSRGRFHEGRGTNYRQDMVEMHISEIGFCSGHSASGVWVNEKAETSVKGLYSAGDMAAVPHNYMLGAFTYGWFAGVNAAQYVNAIEDSELNQSEIEVEKARIFAPLNCSEGLPPEQVEYKLRRFVNDYLQPPKTRQKMEIGLKRFEEIKQDIKRISARNPHELMRAAEVSFIRDCAEMAARASLFREESRWGLYHYRADFPQKNNSDWFCHAHLKKDEYGNMVSFKKPIEPYVVPINQDEAVSYDRLRIQKDVALAD

SEQ ID NO: 7668 - protein, 62 aa, Acinetobacter baumannii
LSEQRGLKIRVVFLAFQSIKKTKITSPISFYIFSPSSLIFMANNKNLSVTGCNISKTSDTKL

SEQ ID NO: 7669 - protein, 202 aa, Acinetobacter baumannii
SIWHMLIRKLFKFENAHVVRNCTSDRCKRSIHGHSYKVELLLKASKLDHGQMVYDFGLLKGVIKDLFDSFDHAICFWEKDDPQYIDACKTFSARWISLPVSPSAEQFSRIFFYLAQQVLQSTVTQNGEGDVEVYSVIVHETDTGYAQSFLEDIQNEQMGLLNLEGIIFSEQVQSEWADPDMYENLKQGIKFHNPHVNLQVEV

SEQ ID NO: 7670 - protein, 219 aa, Acinetobacter baumannii
ARRQYKMAWSRNEMAQRAAKELEDGFYVNLGIGLPTLVANYIPENINVWLQSENGLLGIGEFPTEETVDADLINAGKQTVTARPGAAFFSSSESFAMIRGGHVNIAILGAMEVSEKGDLANWMIPGKKVKGMGGAMDLVVGVQKVVVLMEHCAKDGTPKIVKNCSLPLTGKGVVHRVITDLGVMDITPQGVELIELAKDVTLEQIQAATGVEFYKTLVA

SEQ ID NO: 7671 - protein, 356 aa, Acinetobacter baumannii
IEFKLCKFEFNKKAKKMNKKVIAGILVVIAVVAIGFWVWGYNNKKQLDNNVLTLYGNVDIRQVSLAFEQSGRIQKLLVQEGDKVQVGQVLATLNTNALQIQAKQAQAQLKAQQEAIVKQEVGARPEEITQAKAQLASAQAELDKTNKNLQRLQILVSSTDGRAISQQELDYAKSNQHSADAAVRERQANLELLIKGARKEDREATRAQYEVTKANLDLINYNLTQAELRSPVNAVVRARLQEVGDMTTAQKAVYTLALTNPKWIRVYVNEQDLSSIKMGSTAQIIRDAYPNQPMNGKIGYISSVAEFTPKTVQTEEIRTTLVYEVRVYVHDPNDQLKMGQPVTVKVPLALSEKAHD

SEQ ID NO: 7672 - protein, 73 aa, Acinetobacter baumannii
LIIKVDNIMKKNIFLALVLGLVGCSTAPVVPNTAKPIPNERVYNQNYLKKQTPEQAKVTFSRDKGFSRIWLYS

SEQ ID NO: 7673 - protein, 302 aa, Acinetobacter baumannii
QEIKKYWRYMMKKSTQPLVHFASASLIAACSLLPLSSVFAEETSNAPVATATTEATSNTTTPTPPPQPATSETVKNPYGLEALWREGDLVAKSTLFILVLMSIGTWYIIISKLLQQGKVKRQGKEAEKHFWEATSLDNAAEGLEQSSAYRFIAEKGINSTKSHGGSLLERIDFNTWVSISIQRAIEKVQNHLGGGLAFLATVGSTAPFVGLFGTVWGIYHALTAIGISGQASIDKVAGPVGEALIMTAIGLAVAVPAVLGYNWLTRRNKAVMENVRSFGSDLHAVLLSGEINTNNSINRSIK

SEQ ID NO: 7674 - protein, 331 aa, Acinetobacter baumannii
VSVNLMNQNVTSKVYPWQQTMWETLTTRFPNIGHGLLFYGKQGCGKHAFAKHFLAWVLCLNKQPQGACGECSSCQWLKSDTHPNYVHITTDEENKKQNAKIKIEKIRDLLPFVQQTGEGWRVVVIEPAEALNLASSNALLKTLEEPGERVVLILLADHYLKLPATIRSRLQHFALDRISYTEATSYLNEHLAETASVPAELLLGLSNDMPLQAVEIATSDWFAKRQSFLEDWTKVVNQKNMPLFYSAKWQKELSFSDFMMLLEYLLGDLICVKLNQPQKNIDLQFDQLAQNYNLESLFSLYEELQHSKRLVEQNVQTQLIIDQLFIKLMNV

SEQ ID NO: 7675 - protein, 319 aa, Acinetobacter baumannii
RISNLRKLTMNALVQNTGFLTPTTLAEAMQVADLLANSEIVPKDYQKKPGNILVAMQWGAEIGLQPLQAMQNIAVINGRPSLWGDAVLALVRSSGLLEQFEETQTEDMATCTVKRKGQKAVTKTFTKEDAKRAGLLSKQGPWTQYPKRMMQMRARGWALRDEFTDILKGFGVAEEERDKEIDVTPEPSKLPKHQGTAGLKAQLAEREEQQDKVVELKVSFDVEKCIEDIGKVENLADLKSLGSTIPSDLGEPAQTDIKNAYANQKFYLQLLDDLEVANSIEAINSIMEKQFEPNTSFLTDAQIDSVSALFERKTAELTA

SEQ ID NO: 7676 - protein, 126 aa, Acinetobacter baumannii
MKSKGFTLLEVMVALAIFAVAAVALTKVAMQYTQSTSNAILRTKAQFVAMNEVAMMEINQEWLQGTQSKQVTSQGETWQIDKSAQSTISPNVQKIDLQVSLYDPDKGKVQNGITHMVFFNYPVKAK

SEQ ID NO: 7677 - protein, 76 aa, Acinetobacter baumannii
FPPKACLAKTSTMLLKFVMSNSYVWFIHEHTRFFVKTAKIKLLNFERDCKVFYQRNLFQFSGFAQNFELNQSGTCL

SEQ ID NO: 7678 - protein, 212 aa, Acinetobacter baumannii
KLYKESNCVKMDRQAQFRAREALIFQVAEQLLLENGEAGMTLDVLAAELDLAKGTLYKHFQSKDELYMLLIIRNERMLLEMVQDTEKAFPEHLAFFMLHHLHHPERTVLFHQIEEKLSITAQGVHHLFNELYQVRKQRLRIIIRMTDHYLESIQSHMTTRDYLASIWSLTHGAAAILNSSFYQRYLGSRDTLRVAYIDQALALPKQAVEQYA

SEQ ID NO: 7679 - protein, 386 aa, Acinetobacter baumannii
YFHNYFMVYSVHKTTFSMIEPVTAMTTHSNSVSKPDIDDVNIKSIQTLVTPNELKSELPLSDVASQTVLKGRETIRNILDGSDKRLFVVIGPCSIHDPKAAHEYADRLKALSEKVKDTLYLVMRVYFEKPRTTIGWKGLINDPDMNDSFNIEKGLRIGRKLLLELNEKGLPCATEALDPNSPQYYQDLISWSAIGARTTESQTHREMSSGLSSPVGFKNGTDGGLTVATNAMQSVKYGHSFLGLNEDGQVSIINTKGNPYAHVVLRGGNGKPNYDAGSVAEAENALAKAKVSNKIMIDASHANSNKDPYLQPLVLKNITEQILDGNKSIVGIMVESHLKGGRQDIPDNLCDLEYGKSVTDGCIDWETTEKTLLEMHEALKEVLPNR

SEQ ID NO: 7680 - protein, 283 aa, Acinetobacter baumannii
GNHKMSITQGHVRIQNLSLHLGQVKNRFQALDRVNFEIQPGEFICLLGPSGCGKSTLLGALAGHLPISSGTLTVDNESILEPHPDRGLVFQQHTLFPWKSVLENIAFGLKMKGIAKQKRIEQAKKMVDLVGLKGFEHKFPAELSGGMQQRVEIARVLINQPRILLMDEPFGALDAQTRLKMQMLLLEIWQEIQTSVLFITHDIDEALFLADRVLIMSHRPGRIIEEIPLKFERPRDVELVTSSEFTAIKKHCIQTLKEATQQEELSRLNPLGLGKKSQIKEYE

SEQ ID NO: 7681 - protein, 519 aa, Acinetobacter baumannii
VMHKGIRQSMAWLHSWTGLIFGWLIFAIFFMGSLSYYRHEINLWMQPPLAQFEIKQDVAIKTAYQYLQEHASDAKSWYLTVATPESPVNTMYWEKPDGSYGNATLDANTGQELKLSATEGGDFFYRFHYQLFGVPILIGRLVVSLAAFIMLIALISGIITHKKIFTDFFTLRTFKSQRSWLDFHNVSSVIALPFFLTVTFTGLAIFFYLYLPWGMQKLYPENPYQYFNDIRTNTVTESTTPHPAQNLPVEKLLAQLKQRWGNQTLATMSVKNPNTNQAQITFIQQEDHSITRNQAQITLDATNAKVLGDTRNHSPIATLYAGVYGLHMATFAQPLLRLGLFFSGILGCVMIASGLLLWSLKRQLQNKNSKFHFGHYLVYRLNVATFVGLPCATLAYLYANRLFTVTAPTVNYEIYSFFFVWLISFIIALITKKQYLWQTQLGIFILLSIALPVLNISYLLKNNYIQNFSSYWDFARIDIFFWLFAALAFFIFLKIKPIQYKASDKIQKKLSKLNIEVNS

SEQ ID NO: 7682 - protein, 276 aa, Acinetobacter baumannii
LMNKIILGLMVVPLVLSGCIKKAEEKPTEKTEKTSTIKATEQPPKEENIIPAMLVRNFLVKFQQPKICAPNPDVDGIVCTSKEAITLKSNIEWIDQVIDKEIRKDYADALTPPSEKQKQLNQTQAEGFNNWSQSVVYRFNGQFGQYVQISKVSSEYSGGAHGITTFEDYIFDLKSKKRIELKDIVINGKMNALKEELWKQYGYWCQEKDMQPYISKEDFKVSENFYINQSGGITFDFQLYELAPYAAGPVSLELYDTDQLIKSDFLPPMPTLKTEV

SEQ ID NO: 7683 - protein, 86 aa, Acinetobacter baumannii
YSLKTKLIENMPFQSLPNWFQLGAFLLAINAGMINVLGLITLLHQSVSHMTGNVSMLAMSLVNWQFEHIIYLVLVILCYVCGRIQT

SEQ ID NO: 7684 - protein, 368 aa, Acinetobacter baumannii
NFCNIGKYRSEPKGINMNQANSHELNGRHFQNEPIFTDHNLVFDHHDLSETCRNVGQIFKPHDLKISHQKRDFSATMHHVKTGALSISRLEYGADVIIEPDHLDNFYLIQIPTQGYAEIEFGSQKFISYSQVASLISPQQSLRMRWHANSPQLILKVSKDDFTYHCRQHIADSENNLLIFDPKLDFSTQGGAYFLQLVRTLMDALACEQHPLHHPLAFKQFESNLFNALIYGQPNNALHKIDQYKEKTVSPYFVKRTEAYIKEHLHEPLNVEILAEHAGVSVRTLFTGFKNYLGTTPMSYLKELRFEQAHLELMHNENLSVTDVAFKWGFTHLGRFSQEYKRRYGELPSSTRRSGQNEGSGLITSIFS

SEQ ID NO: 7685 - protein, 321 aa, Acinetobacter baumannii
LGCKLNAYMINQLYEQYSTMALSAWGFTDLPSYTDKYDPNEKDIVIKTNNWLNDEAAEEKTQQGLTAFVALDDAFMSIASRIYLIRNAKETIDLQYYIWTNDFVGNLILHELLKAADRGIKVRLLIDDQNGIKLDGILRSLLQHTNFEIRLFNPYKFRYLRIFDYLFRFKKVNHRMHNKLIIADASIAVTGGRNISSEYFEASSKFQFTDMDILFYGHAVRHAQAVFTDFWESTLSVNATEIIGTCAEHHLKALREHYEQLHHEDHSLTEDKLYDAQSYLKELLEHNPIQWSKAHFVADSPKKILGTATEHEILYGDSMSS

SEQ ID NO: 7686 - protein, 65 aa, Acinetobacter baumannii
KILKENMEVYAMSRGDKSSYTAKQKRQAKHIVESEVDRGHSQEEAERIAWSTVNKQDGGGKKKSH

SEQ ID NO: 7687 - protein, 192 aa, Acinetobacter baumannii
TVLNRVNPMRSIVDLCNLALSHLAQGYVVNELTEPTKHARLCNTFYPICRRELLDNEHQWTFAVKRVRLNVDAGYEFGTAYVLPSDKVRIFQLESGSRFYVEGNLLFTEDTAPILRYVHDVKDLALMPDSFKTALSYLLAARIAGPLTQNEQKQISMMQLYEIEKNKAIFIDLQQHRIEARPEHTGSMFEAR

SEQ ID NO: 7688 - protein, 892 aa, Acinetobacter baumannii
AYLKLAVEITAFFIGGQNMTVPVSDRLSQLYVGNGTNTRFDFTFRIFQQEDATGVAVRKKGTTDFETIDPATYTVTINPDDMGGYITFNTPPTVGTYFYIAGASPLDQLLDITNYDNFYPDAIERALDKLTALLQEWGTKLDLEKQARILADIHYDSLAMEREENLENRLISYINAVVGITNPNIFDGISDRMIITKDGRTQREFNDTLPYWTDDYANFKQQTFLREEQILEHVKQEDASLDQKINAENIRAIQAEQVLDGKIAAIGGGASHGYTSYTEMVADAANIPANSVVTVGGDPDSTKDGDYIYNGTTFSKSPYDPLTQSKNYTNSFSSLTKNSTVVYPFISRKRNNVNESAVPVTHEAFLKPYILSVRVMNANKDHYYRVQQISNPDHATAANRWIFEILARGNFETAETRISTITAVLPIVKNSGIRDFLVEYGDVKIGITLDTNKCPTFDFYSVASTDNSYTYIFDPSLYSYAAVGSSDLAALSTRIDGFIKPMQLKNLLNDLRNPIQSVQIKLIGDSITYGLGATDNGSGGGVLGVHGPATTKTWANLLRNYLGTAFCTSPRYGDDTIVQTGEAYFTSDGTSVLSAELSNFTFKNSATGKEFTVAEMQALVGSIASSPVGTFIDLRSPALTSVIAPTDMEFLFNGNEFTINHARLGNGSATESFIDVYVDDVLHSSFNVYTASTPDFLGAYTVSGLADGQKKIRIANRLTNTTIYARLVSITATRKISVINEGVSGWNTGSWLSGDNISNKISIKDNYVIMMLGTNDRHTTQKIGTFKNNYLQLLDRIGAKNSKAQIIVMAPPAVTQSEDPSTGRLFRIADLNYAISQIAQLRSISMINLFEATSKLKAQGIEFLLPPPDQLHPNDYGYGVIAEYIINQILNA

SEQ ID NO: 7689 - protein, 112 aa, Acinetobacter baumannii
YLLNDILVELPMVDVGKTQLKQFLKPLTKAERIAFAEKCGTTLGNLNQIIYSKTSCGAALAIAIDRESKGSVRCDDLCPSADYEYVRKQNEELKEKKCTSKKFRMIPIATNC

SEQ ID NO: 7690 - protein, 406 aa, Acinetobacter baumannii
FRLKANLANTPIRDIKMSSIVIVSGSRTAMGGFQGSLSSLTAPELGAAVIRESIQRAGVKPEQVDEVIFGCVLSAGIGQGPARQAMRKAGVPDHVGAVTINKLCGSAMKAVLMASDTLKAGSANIIVAGGMESMTNAPYILPKARGGYRMGHGEIKDHMFLDGLEDAETGRLMGSFAQDMANTKGFTREQMDDFAISSLKKAQTAIMEGYFKEEIVPVEVKTRKGVEVIDQDEQPLKANLEKIPTLRPAFSKDGTITAANSSSISDGAAALVLTTEEYAQSHGLNTLAKIVATSTHSQHPSEFTIAPISAIQKVLERAGWSVDEVDAWEINEAFAMVAMAPIHELGIDEAKVNVHGGACALGHPIGATGSRIILSLIYALKRLGKKKGVAALCIGGGEATAVAIEI

SEQ ID NO: 7691 - protein, 125 aa, Acinetobacter baumannii
RFIKMSEEQIEKQIQAKGLNAPRITPDQLDSKIKNVYYHSPLANADPKQAMDEKTYQALRCLTFCTIVLENGFTVTGESACVAPENFDPFIGQEVAYKNAREKIWQLEGYLLKEKLYQADLDKQF

SEQ ID NO: 7692 - protein, 203 aa, Acinetobacter baumannii
AEIKLAKFRIDLLRHGESQYSHTLRGHLDDELTAKGWQQMQATIEQVTDQTWDVIVSSSLKRCACFAEQLAKTAELPLLVNHDLKEMYFGEWEGVSTQQIYETSPELLANFWQKPSQYCPPCAETLNQFQTRVLKGFQNLLEQMQKQNLQHALVITHGGVIKLLACLARQQPLDDLLKMPAELGKLYSLEFSETDGQVTFKLR

SEQ ID NO: 7693 - protein, 172 aa, Acinetobacter baumannii
GRIKVSTVPFVTCDLLDDNPEKDLQVVTPSMDGKFFKSYGARQTFGGQVVTVKCFEDNSRVKELLATDGTGKVLVVDGGASMRCALMGDMIAESAVKNNWNGVVIYGCVRDVDALASLDLGVHALAAIPQKSNRKGIGEVNIPLYFGGVTIQSGDFIYADNNGIVIAKEKLV

SEQ ID NO: 7694 - protein, 299 aa, Acinetobacter baumannii
VAIKMSGAFEFILAGMLVGFCVGITGVGGGSLMTPILIGLFRIEPHIAIGTDLLYAAISKFCGSMVHAKKLNIVWPIVLWLAVGSIPASFGTAWVLEHYLSQSTHYKAVLTMVLGFMLTLTGVSIIFRTRIEKFFNKFRNKENTQTENEQFAVQNKRTYIVIMGIILGVFVTLSSVGAGAFGIMALVIMFPNLPMIRIIGSDVVHAVLLTLVAGLGHMSAGNVDFVLLMWLLVGSIPAIIIGTLISSRMPERLIRKILGITLFALGVNFMVHPVKAKPKAAVVQQQAVVAEKTGNSTER

SEQ ID NO: 7695 - protein, 189 aa, Acinetobacter baumannii
NMSKKDDIITTALRLFNSYSYNSIGVDRIISESGVAKMTFYKYFPSKEKLIEECLLLRNSLLQNSLTAAISKEDETNPLARIKAIFLWYSDWFNSEDFNGCMFQKALEEVLKQYPSTHQPATLYKIWLTQLMQDLLIQYEIEESRPLALLLVNILEGMTIQAQVEHGSVKIDDYWKRVEKLIEFEKIAH

SEQ ID NO: 7696 - protein, 73 aa, Acinetobacter baumannii
LTPKHQAENLLRLPNLKKRRPRPIKQRIQTMKSKPKSILMFWFLVAVAIVVLGSDVYRIVVLKQHPYSTVKGE

SEQ ID NO: 7697 - protein, 68 aa, Acinetobacter baumannii; identical to SEQ ID NO: 7346

SEQ ID NO: 7698 - protein, 577 aa, Acinetobacter baumannii
RQQKGIKSTMKKKYNVRSQATPKIGKTILKLSTLSLSMMCLTMAQAAETEQSSTDEKPTKVVKVAVTGSSIKGVAAQSASPITVVKVDEILKQGVTTTEEALAKISANQSSFVTAQNVGASGTVGSAADLRGIGANKTLILLNGRRLAANAYDSGVTNLNIIPLAMLDRIEVLRDGASAIYGTDAIGGVINFITKKQFTGLNISGGLTQPEQNGGDTQDVSVFGGYGDLDENGFNIFGVVDYRHGNDVMAKDRKVSKRGGLLPELGITKGSSGSFPANFYDTKTGTEGNPYAATGCGNNPLVYAQGGFCRYNSQAVIGIVPKTEDISALGRATFKLNDNINAVAEYVYARNEITTSVAPDVFFDLTLNPDSKYYPGNGITPAMNKVSGPLELYIRSQAGNRVSSSINESHRIFGGLEGEAYGWDINTGITYAHSEAEDRLNSGYLNYKKTQEALNNGILNPFGPQAPEDAGLWDTLGVTGTYLKADVDSTTVDFTASRPIFTLPAGDVGFAIGASYRHDEWTSNVVSEVASQAPSTGVDPDEPTNKGKRDIKAVFTELHIPLTLNIRNSTCSPLRRI

SEQ ID NO: 7699 - protein, 133 aa, Acinetobacter baumannii
NNENIRLVAKMNDPLTIKSLPWFIKIWAAVMGGIFALMLSGDIDVEGKIKINIGVIIKFAISVSISLYGGSAFIEYQDWGHYSHMTQGFVMLIFAVFGMLLIGIWYQAIQLLKGKTISELIFEIKEAFKAIFK

SEQ ID NO: 7700 - protein, 333 aa, Acinetobacter baumannii
LGEKDMISLSQQMELNHYSRKAEFAQNLMSTICGEHRLDTIYKDNLDFHYDGMRLPNKKMAIGTISYGANVAINISNLKAYSISLPIQGRQALNIRGAHYQSDENRGLIVSNNDQQDLIIDKDCRKFQVVIPERSMQIVLADLLNKPIETPIIFNPEMHLDSEQLIGAWWKNIQNFLQLKSQYSNFYGLQMLSEDYENFVIKALLLSQENNYSKALKSLSHQDEPAYIRKVRNFIIEHAHEEICAEDLQRLAGVSKSKLYDEFQQYYGTSPMSYLKKYRLQQIYKILSTTGADKKVSISKLAYDWGFNHLSRFSQEYREEFGENPSETKGKIF

SEQ ID NO: 7701 - protein, 66 aa, Acinetobacter baumannii
KSLKAKIFTVWLLRGAGVLESLSSLSLQPTNKAIARHKDVVLNSMFKVVIFLSIDELRCIKNTHRV

SEQ ID NO: 7702 - protein, 256 aa, Acinetobacter baumannii
AMLNQHEINLKQYQNKSLSYLNSTAHSEGVEFDKFIKEIDEYPNAVVLDLGCGGGHVAYNVARHADLVFAYDLSHEMLDTVSKAANARKIKNIFVQQGIAEDMPFTDEQFDVIISRYSAHHWQHVPTAMKEINRVLKPNGTVIFVDIISSSFPILDTFLQTIEVIRDPSHVRNYSIKDWVHFIEDAGFELTILEKQTLKLDFDSWVQRMKTPEDQIKTLRYLQENAADVVKKYFNIQKDGSFESKVGYFVFKKLSF

SEQ ID NO: 7703 - protein, 186 aa, Acinetobacter baumannii
VDMKSNLPFQPQKGFTLIEVMVVIVIMTIMTSLVVLNIGGVDQKKAMQARELFLLDLQKINKESLDQSRVLALETHGETDVSPFSYELYEYHDQSTLQVQDIKNRWQKYTEFKTRQLPAHVSFSVQPLDDQNYSKAKNTDLIGGQTPQLIWFGNGEAKTVKIQFYLEQKPIGSEIQIDHLGKINEI

SEQ ID NO: 7704 - protein, 363 aa, Acinetobacter baumannii
NKMKRLKSLVSEQSQIKHLSTRLFRPQTLVLSQSTPFEVIGEFNQTRVRYYAATEKSFREPLVFVAPLAINMAIYDLYPYRSLIKYFQNAGFDVYLVDWGRLGFKDRHLNFLSFIEDFIPKAIELVRTHSGSDQISLHGWSMAGIFVTLYTAHNHPNYVKNLIVLGSPIDSYASGYIGKLYRTINNTIARNKKLQERIYSGLPKRLIHTPGILNSLGFKILDPKGWFDGHIQLLKNLNDLQFVQEHATLSSFLKNMIDYPGGINQDMLFNVWLQNPLRQGSIQLKDKKIELKNIDCSLLVGAGRSDQLVTADAAQPLSQLTSSQDVTFTLIPGGHLGLMSSQASAQEFWPKLATWLSERSTKI

SEQ ID NO: 7705 - protein, 627 aa, Acinetobacter baumannii
TVQNRPIKEIGLIKMGQLHPVLSNTHVIQNALQAWQHPNSDQAKYVEQRVIKQLLQALIFEDIIHSEYDGKNFIIEVQNSQRQTIRYVAAGQRQYSYKLVRLARNQDVFRQDENGHYQIATLNLVIDEILRTITDAAKVEDFIFELKRTFIHDLQSQACFDHYALPAIQYPYDILESYLMDGHPYHPCYKSRVGFSLQDNVRYGVEFAQPIALVWLAVHQDIVAKKHSEDIEPDLFFKEQLNSQDQELFLQHLSDRDLKADEYIWIPVHPWQWENHLISIFAEEILNGKIVYLGQSQDRYLAQQSLRTMTNLQHPEKPYIKLSMSLTNTSSSRVLAKHTVMNGPIITDWLQRLIKQSKTAQELDFAVLREVYGLSVDFTKLPKSHAQQAYGTIGCLWRESVHQYLREGEDAIPLNGVSHIQKDGQALIAPWLQQYGVESWTRQLLKVVITPLIHLLFAEGIATESHGQNIILVHKQGWPTRVLLKDFHDGVRYSPAYLAHPELAPELDQLPPEHAKTNSMSFILTDDLNGIRDFSCACLFFVALTDIAIFLNQNFDLPEKKFWQWAAEVIQNYQQQHPEHASRYQLFDVFAEKLRIESLTKRRLFGDRSIQIKFVDNPLAPFKLQVK

SEQ ID NO: 7706 - protein, 140 aa, Acinetobacter baumannii
FKENLTMALVDKLLQFSDKQAIAAGASTFTLDTVHKSVGTAGLPICLQGHVVGPANATVTVTLEESADGTTFTAAAASKAFKAAELNKGTFFYVNSATKRFIRLSYAVANAPTGSISAWLGNEADIRTNYDAVSGATVPV

SEQ ID NO: 7707 - protein, 109 aa, Acinetobacter baumannii
NIGNKPYIEYRFIPLTEEKLMNKLMVAVFAGMVTLAGFSAQAATPEQECQKLQDDYNLIYASKGFCFKDQDAKEKYGNENCHTTKPKFSDKEQQRLDAIKERQKELKCK

SEQ ID NO: 7708 - protein, 478 aa, Acinetobacter baumannii
VMLDFIGIGLGPFNLSLASLLHDKSELQYRFFDQREKFDWHAGMQLPNAMLQVPFMADLVSMVEPTSPFSFLNYLKHHQRLYKFYFRENLYIPRQEYNHYCQWVVEQLNHIEFSSHVLDIKPIKGGFDVEVVCNGHHQHYRTRQLVLGVGTTPHLPESLQQIYSKSGTCLHSSEYLQYSSQKLSGNVVLIGSGQSAAEIFLDLFDRQYMNGRTTPDFHLYWLTRSAGFFPMENTPFGLEHFSPDYMHYFYNLPSGLKAELPAQQANLYKGISSKTIRDIYERLYHRSIGGMPTDVTLAGHHQLQYAELLENQKTKLCFEHRQQNKNYILEADCVIAATGYRYPNPKFLQNLQSLIIRDQADHWQVGSNFKVNYQGEGSIFIQNMEVYHHGVGTPDLGLGAYRAATIANQLVGEELFKLDHSQSFQQFGVNASAQKEVSVRNIAASKITEFSRPLNKSGPMHHSALGAYARSKLSEHIE

SEQ ID NO: 7709 - protein, 100 aa, Acinetobacter baumannii
MTTEALNKSDLIERIALKNPHLAEPLVEEAVKIMIDQMIEALSSDNRIEIRGFGSFALHHREPRVGRNPKTGKSVDVAAKAVPHFKPGKALRDAVNESGK

SEQ ID NO: 7710 - protein, 724 aa, Acinetobacter baumannii
IKHDQKRGKNVLIFHGKPVHGAIFDMDGTMFDTERLRFQTLQQASQELIGQEFSHEYLMQCLGLSATTAEKLAQRLYGVDVPYKEIRKRADEMELEHIRKHGVPIKKGLVQVLERLRKSGLRMAVATSSRRAIAEEYLINANVYKFFDVITCGDEVEQGKPHPEIFLKAASQLHLDANQCLMFEDSENGLTSAHTSKGLTILLKDIKEPNDEMLEKAHFYYDQMYEFLIDLDQFIPVMDTPEIQEPFPQSLNQLTVGIHGFGAIGGGYIAQILSHWDGYTKPKRIIASTRNSLFREAVNAFGTYSIRYGQFSYDERIENMTIVDSDNEQQMLEMYTHSSLIALCLPEQAIEAESKIIAKGLYARFNSQLETCIEPLTFLIILNKVGAKYLVMKHLKEALLELTNDEDVTEHILKEHYFCDTVVNRMVSKLSNQNLYRQLRIKHNFLEQHLEDVEQEDQIEIEDCNKLTPDQLNQASIYVDNMRRNFQPGHILQSMDLILFHSESDMPIYVEKGSPLLEKLRQVVLVDQITDIQLIKNRLWNGVHAMLAWYASLMGYESIGVAMGDHLVKAFAENLIAEVKQGLAIVLPNYAKDLDRMSQSFLDSCEYAFKDPCQRVARDPLRKLNHNERVMASIAMNICHDLPYKNLLKGAALGYAYAIQFLEIEETKAVEHLQQQIQNLDLSTTQRRQLEAELVQLIQYLFSEQGKQPLDKLNNTKTTSNQYV

SEQ ID NO: 7711 - protein, 430 aa, Acinetobacter baumannii
NDCETYKMAKLNFESEQDFYILFEQLKALFPNAILFLADTSTQAIHYKFNTDDISVENMAALTQDHHNQYLEINTPKMRKRFIYQEHDIYLTEHRIIGKLHILQPVSIENDIADQVELTEQLQELSKIFNSCSPEMTRMFSIIQRVAITEFPVLVRGESGSGKELVAKAIHDYSQRKNKIFVAINCAALNSNILESELFGHVKGAFTGAIRDHKGVFERAAGGTLFLDEIAEIPLELQAKLLRVLETGEFTPVGGEKPIQANVRIITATHKALREEAKAGRFRHDLLYRLRVIPIFIPPLRERKVDIPLIVDQILKESSTQLDTMPRHVNQKAMQVLLNYDWPGNVRELKNTLLYALTMANGKDEIEVEDLPNELLNAEDYVKLPETNAELSPENVQAALEKYNHNLNMVANIFGISRTTLWRYRQKHKL

SEQ ID NO: 7712 - protein, 240 aa, Acinetobacter baumannii
LSSESKIMIKNKYIHIRSFAARLAARSSSARLTRASGFTLVELLVAIAIFAVLSLLGWKIFDYLLKVRDRNAEHEVHLFELQDAYQQILRDTLQIIPLSANQGGQLHPALEIDNQILRFSKAGVTDPLKQGLSPFERIEYRYDADQKKLYRLKYTNLNTSNREQPLSSTLLSQVDQYQIMVLTPQEVTKWPEVNIDPTKPNELKKLPKGIKIQLTVAGVNYEWIYSLNQGDLSLSQEGNS

SEQ ID NO: 7713 - protein, 71 aa, Acinetobacter baumannii
GMSEKAFKDLKIRFHLAIGVANGDREDFGKLSDWIEEENWKMMDEEEQKDTLSEIAEEWAQQYLDLGATVE

SEQ ID NO: 7714 - protein, 383 aa, Acinetobacter baumannii
RNFDMDMSKQLLLPSTDNLPSFFRPETISETPCLGKKPSLDLDAAPIFDLDQEWQHSLFGRSIQECHRNLMHIAEDADMAIGVTDPHGTLLWTWSSTPMRSSAEQVHFVEGGQWSTQAVGQNAIGLALNTHSASCVYSHENQMNSVRDWVCYAAPITDANTGQFYGIMNLSTKYQKHNSLGILAVERCADIVKQAIQLHQKNILYIKALGTPKVQYNQHSLTLTQRQIEILCILALCPEGINLEELHYALYGDRPVSTTTLKAELSQLRNLIPDVIESRPYRLNCEIQCDFLMAEQALNLGFTATTLTLYRGSFLAKSESPFLCAWRDCFDARLSHVIYQIDDVDQLLRVVSRVPDRVDAVERLLELLPEETPYRAKLLKLLE

SEQ ID NO: 7715 - protein, 137 aa, Acinetobacter baumannii
ADPEVWRSEMAYSEKVIDHYENPRNVGVLDKNSENVGTGMVGAPACGDVMRLQIQVNDNGVIEEARFKTYGCGSAIASSSLVTEWLKGKTLDEAQAIKNIDIATELALPPVKVHCSVLAEDAIKAAIEDYRSKKSKA

SEQ ID NO: 7716 - protein, 222 aa, Acinetobacter baumannii
TMSEVTTTTTATDAATTATTTDAPAATTTETGGGNPATTQVETTPTTTTTTDNAENTETKPEVLLGGEQPPAEQPIQYTEFTMPEGYSMNPDDSKVLQELGQQFKMPQEAVQKLVDLGVQMQQRQVQEQQKTILSWLDAAKADKEYGGENLEKNLLTAQRAFSLPRGDEISKILYMSGLGNHPAVIGFMTEVGKLLEPDNMTHGRGTNTANVAPAAVWYDKS

SEQ ID NO: 7717 - protein, 303 aa, Acinetobacter baumannii
KGIDKMNLEVRWVEDLLTLERERSISKAAEKRFISQSAFTRRIQQIEEMIGAEVIIRNNKNNIEFTDIGRILLVMSKNIEKQVEETAKLIKNSKNETESTIRFCVVHSLASGFLTTFLKKFPTLIRDLKIEIVATNSGEGLSLLKEGACDFMICYADKSNIRKVGDDILSGIKIAETVIVPVSATEPDHSPKHTIQSNFALLAYSKHAYLRKLVDQLIEGKLIYKTLYETDNATNLKELVLQGLGVAWIPKINVEEDLAAGKLVILDQQEYCLAQDIYIFKNNLSDNKSVQKIWNGFKGQQDL

SEQ ID NO: 7718 - protein, 408 aa, Acinetobacter baumannii
DQSEDISMNLQNPKKFKIMIDQAHDVAINVLRPISRKYDKAEHAYPKELDMLASLIDGMNEGGEGINAGAAGAGKRGETDNEGVRNGTNMSTALGIIEMCYGDTGLLLSMPRQGLGNSAITAVANDEQLERFKGTWAAMAITEPGCGSDSAAIRTTATKDGNDYILNGEKIFVTSGERADSVVVWATLDQKLGRAAIKSFVVPKGTPGMKVERLEHKLGIKASDTAVISFTDCRVPAENLLGNPEIDVAKGFAGVMETFDNTRPLVAAMAIGCAKASLERIKEIFKDQLDPNYSTPYLQTSNLAAQIYRMEAEWEAARLLMLKATWMADNKKPNSKEASIAKAKAGRVGNEITLKCVELAASVGYNEDELLEKWARDSKILDIFEGTQQIQQLIIARRELGKSSSELK

SEQ ID NO: 7719 - protein, 131 aa, Acinetobacter baumannii
GRAERYSFRNCRGMGAAVFRFRSDSRMSILDKNYIVTMPDESKWAVPVRIIAESRAKYYAGVDEVSFEESLNDDTVPLFESDDYEIHDWAANNMNWRDVKDHAIQIERPSLDYEDGWVNGEYEVKAESKEG

SEQ ID NO: 7720 - protein, 145 aa, Acinetobacter baumannii
SGADIMGMSVGSEDDEEMIGTINTTPLVDVMLVLLIIFLITIPVVTHTVPVKLPEEKNTPYATTPENIQLSVNKKGDIFWNESYVPNKEILLAKLQAVAQKRPQPEVHIRGDQLTHFEAIDQVISTTKQAGIGKIAFVTTPPASP

SEQ ID NO: 7721 - protein, 575 aa, Acinetobacter baumannii
VNQDFKVYLRLISYLKPYWGVALLVLIGFGMNSATEVSVAKLIKFIIDAIQNASRADLDWFPLLIILLVFFRGLGLFMGGYYTAVISRSLVFSIRQEVYAKLLRLPAQYYLDNSSGHITAKIMYNVEQLTAASSESLKTIVRDGMITLGLLGYLFYTNWRLTICIMVFLPVIGILVRKASKRMRKLSMQVQDTMGDVNHVVQESINGNAVVKSFAGEESEQERFYKSSEENLKRGLKMVIVQNLNSPVVQVVMACAMALIVWLALRPQILGNTTAGEFVAYITAAGLLSKPVKNLTDVNEKLQRGLAAAHSVFELLDLPEEQNSGELKPQLQGAIRFDHVVLNYADGTQAIKDFSLDIRPGETVALVGRSGAGKTSLVNMLVRFQEVSSGQIYLDDLPIRDIELSSLRTQIAMVNQQVVLFNRTVRENIAYGQLHNASDEDVIAAAKAAYAHDFIMNLPNGYDTVLGAQGLNLSGGQRQRIAIARAILKNAPILILDEATSALDNESEHFIQQAFDEAMQDRTTIVIAHRLSTIENADRIVVMDRGQIVEQGTHQELLAKHGAYYQLHQRNFEDH

SEQ ID NO: 7722 - protein, 630 aa, Acinetobacter baumannii
FFKDHSISIQFQFSSNIHTLCVFFMHLNSSIDKKMTTLNILFKTTSLCLAMALLVGCNDNDDNDSSTPAPRSNQTVNILAFNDFHGNLEPPKRYVEAANPNDASQTVRIPVGGVSYFADAIKKLKAQNPNNAVVSAGDLISASPLTSSLFLDEPTIEVMNDIQIDFNAVGNHEFDRGTDELRRLQNGGCQQYTSTAPCQINKNFSGAKFNFLAANVAMKNDTSKTIFPAYKVKTYGGIPVAFIGLTLKATPSIVSAAGIKDVEFRDEADTVNALIPELQKQGIEAIVVVVHEGAAPSTKLNQKTCDGLSGPILGILDRLNPAVDIVVSGHTHQSYICDYATKNPAKPFLLTSAGQYGTLITDIKVELDGKTGDIIKKDAKQIPVQSEAYTSGTTTVSLTDLYQKFSKTPSIEAILDKYRQAVTTISGRVVGTSTAVVSRTQVESGESPLGDMIADAQQAAALQASNQGSDFTLMNPGGVRADLLINSNNQITFGDIFAVQPFGNSIVTLSLTGKQIRDVLEQQWSGANANSPRILQPSKELSYQYAANTSVSPRANNIMVAGSPLVDTKVYRVTVNSFLADGGDNFTVLKEGQNRVGGGQDIDALENYVAQNSKDSPLIIPATTRIKVIK

SEQ ID NO: 7723 - protein, 94 aa, Acinetobacter baumannii
MNKEQFDVNLVPTWRQGYRFQFEPAQNGFVILYPEGMIKLNESAGAIGQYIDGTNNVSTIIAQLKQQFGDVAEIDNDVIDYMLVAQQQHWIDLV

SEQ ID NO: 7724 - protein, 103 aa, Acinetobacter baumannii
SMKDGLQIEEMKNAADSVVGTLKSLANTDRLFILCHLAHEELNVSQIEEKTQITQPTLSQQLMMLRKSDVVSTRRDGKQIFYSIKDDKMHSILNMLYQLYCIE

SEQ ID NO: 7725 - protein, 443 aa, Acinetobacter baumannii
SILDTTLMKTKHLKQFFKATTLAVLISSSMHSFAQPTDEVVAIVDNSVILKSDLEQGMAEAAHELQAQKKEVPPQQYLQFQVLDQLILRQAQLEQVKKYGIKPDEKSLNEAVLKVASQSGSKSLEAFQQKLDAIAPGTYENLRSRIAEDLAINRLRQQQVMSRIKISDQDVDNFLKSPQGQAALGNQAHVIHMRISGDNPQEVQNVAKEVRSQLAQNNDLNALKKLSTATVKVEGADMGFRPLSDIPAELAARITPLQDGQTTDLISVRDGVHVLKLLERKQNEQKALVPQYQTRHILIQPSEVVSPENAKQIIDSIYKRLKAGEDFATLAATYSNDTGSARDGGSLGWVTPGMMVPEFDKKMQEIPVGEISEPFQTQFGWHILQVTDKREKDMTHEYQERMARQILGERQFNTEIDSWLREVRANAYVEIKDPSLDKKNLQK

SEQ ID NO: 7726 - protein, 418 aa, Acinetobacter baumannii
KIMENIMRRIAIVGAGQSGLQLGLGLLDTGYDVTMITNRTADEIRQGKVMSSQCMFHTALQTERDLGLNFWEEQCPAVEGIGLALVNPENGGKAFEWSARLERYAQSVDQRVKMPYWMEEFERRGGRLVIQDVGIEELEQLANDYELVLLAAGKGEVVKQFERDDVRSVFDKPQRALALTYVKNMKPISPYSRVTFNIIPEVGEYFSFPALTINGPCDIMVFEGIPNGPMDCWQDVKTPEQHLQCSLDLLKKFVPWEYERCANVELTDAGGYLAGRFPPTVRKPVLTLPSGKQIFGMADALVVNDPITGQGSNNAAKCSKIYFDAILANDNQSFSEQWMVQTFERYWAYAEQVVAWTNSLLLPPEPHVVELLAAASQNQSIASIMANNFDDPRAFAPWWFDADQAQAFLASKTAAKVA

SEQ ID NO: 7727 - protein, 203 aa, Acinetobacter baumannii
KKSENLKMNQIDTYKALVTAYKEIATSTIGHVLDQGYIPQVFPLRPEDKVVGIVRTVRIESINASGLRQVLMSCQPNEVLVIDARYDLQRACWGEQRSVAAIHCGLAGVVVLGAITDRQALLKLKLPIFAHTTSCLTTRNEGESLVEIDAKIHINHTIVQTGDLIVGDADGIFIIKMDVAQQYLKEFQRLEQNEQNKKNEFFL

SEQ ID NO: 7728 - protein, 304 aa, Acinetobacter baumannii
VQAETILFDLDSRLLNIFYHIYRFKSVSMAADAIGLTQPSVSNGLNKIRQHFNDPLFIRVGNEMIPTELAKQIFPLISEVIDKVESINNFNVNFDPLTSDQLFTIAMTDVSHLVLLPQLTNYLKEKAPLIRLNIRPITPETSYQMANGEIDLAIGFLPQLEEGFYQQKFFRQHYVVISSKSHPRLDPNNFTLEDYMRESHIDIDAGIGHYHIKNELQNKGLDRNILIRLPSYLGVGLVVQETDAIATVPYYLSQVLLVRENLQILPAPLDFPTYDVKQHWHMSCHHKSSHKWFRQTCYELFKTA

SEQ ID NO: 7729 - protein, 494 aa, Acinetobacter baumannii
NVEDRVQLERFIDREPKQFAYFHRLMGYSILSLILVIYAFTSPNTNYQIYIPPFFLFLLFVSSKLEHWLQYQFDKKTQKSVFFAIDAIVVAVTLAGVHLNLVPTFIALFALFYSAINSRISFAVICLTSLLGAIIFYLSTFFLFGFHPYFEATSQELTVITLLGLVMFITIGNYYQHRWVKKISQQRQHYYDQMTRYIAFANQLSRYAPLQLWQSIMRGEAEAKIEYKRKKMTVFFSDIQGFTELSETLIPDDLAFLLNDYLSHMTEIAKQYEATVDKFMGDAILIFFGDPNSQGVEQDAKSCVEMAIAMRQQMKLLRERWKKMGYSALHIRMGISTGYCHVGNYGATHRMAYTIVGRDVNLAARLQYAAEIDEILISDDTYQLIKSDFLCAPKTPIYLKGIQGAVKTWQVMEKYTGNKSDHQQWFDYEYKGFHLVLNLEEVQNYEYPELVEVLEKMIQRIKVQQTLVNTQGVAQLRLEDEVKPINIDEEQDQV

SEQ ID NO: 7730 - protein, 620 aa, Acinetobacter baumannii
LMALLQIAEPGQSSAPHQHRIAIGIDLGTTHSLVATVLSGKPKVLNDVQNRRLLPSIVHYGDNTTHYGEEAKPFIIADPKNTIVSVKRFMGRSKADIKFQHPYELVGSENEMPAFETRAGRKTPVEISAEILKQLKDRAEDSLQNPVNGAVITVPAYFDEAQRQATRDAAQLAGLNVLRLLNEPTAAAVAYGLDQESNLATDRNYVIYDLGGGTFDVSILRFSQGVFEVLATGGHTALGGDDLDRLIVKWAKKQLNIDVLSDEDYAVFIVAARQAKEQLSTQDSVELKLLEATLTLDRPTFESIIQVALDKTISVCKRVLRDAKLELTDIQNVVLVGGSTRSYAVQKAVREVFAQEPLCTINPDEVVAIGASITANQLIGNSQDGSLLLDVTPLSLGLETMGGLVERLISRNTAIPVARRQEFTTYQDGQTAMLIHVVQGERDLVEHCRSLGRFVLHGIPPMTAGQARIEVTFQVDADGLLTVSAREATSGVQAHIDIKPSYGLSEADTERLLIEGFQHAEEDKNLRHLKETKVEAERELEALEQALKVDADLLDEKQLEALNSAKESLKAQLEGSDIQAIEQAVQQLKVHSDAFAALRMNRHIDHALKGTKLDDWSKSN

SEQ ID NO: 7731 - protein, 261 aa, Acinetobacter baumannii
MTKLLDGKVAFITGSASGIGLEIAKKFAQEGAKVVISDMNAEKCQETASSLKERGFDALSAPCDVTDEDAYKQAIELTQKTFGTVDILINNAGFQHVAPIEEFPIAVFQKLVQVMLTGAFIGIKHVFPIMKAQKYGRIINMASINGLIGFAGKAGYNSAKHGVIGLTKVAALECARDGITVNALCPGYVDTPLVRGQIADLAKTRNVSLDSALEDVILAMVPQKRLLSVEEIADYTIFLASSKAGGVTGQAVVMDGGYTAQ

SEQ ID NO: 7732 - protein, 203 aa, Acinetobacter baumannii
AMKLLQIDTSILGEQSVSRQLTSSVIRQLSTAYPDAEIIHHDFALEPIPHLSDAEFLAWQGVEPNNEIAQQRVARNTQYLDEFLSSDIVVIGAPMYNFSFPSQLKAWLDRLSVAGKTFRYTENGPQGLVEGKRVIIASSRGGVYSEGSPAEALDYQETYIKAFFNFIGVTDITFVRAEGIAFGPEARQAALDNAAAQIAQLAG

SEQ ID NO: 7733 - protein, 527 aa, Acinetobacter baumannii
SHIWLMNILFKTTVLAASLLLAACNNNDDQEAQTAPSTNPSKYYQTKTPYQPQQDLKSYEQAPTGFQPVFTELVARHGSRGLSSLKYDLALYNLWKQAKAENALTPLGEQLGADLEAMMKANILLGYGVEGIRQYGYGNETMTGILEHRGIADRLLQRLPTLLNAQASILVQSSGVDRAVDSAKFFTAELIKQQPQLKDKIVPLSYTNLSSESVPSIEDGGVDRFKLYFHSLNADEDLAQPLSVSQQKIYDASQAYQDFEENNKDLAQKLDELTKNTQAEKTAQMVLSPIFKANFIKKLGTTGYSFSNTGSFTVTSPKGEQITEKGKGKNTIASAVDAAAYIYELYSISGGMKDELKGIDFDKYMPLEAAKFYAEFNDANDFYEKGPSFTESNKVTSEIAQGLKQDLFQQVDAVVNKAQPYKAVLRFAHAEIIIPLATSLDLHNMMQPLPLRQTYNYSTSAWRGEVVSPMAANVQWDIYQNNQGSTLVKMLYNEKETLFKPACNYARYTPTSFYYDYIKLKQCYQMQ

SEQ ID NO: 7734 - protein, 99 aa, Acinetobacter baumannii
TNHWLARSNKSRTTRCGNVDLGNVGLGEMFMPVLAFLPEFIVKDKVKRDSTPKVTESDVKNIRTLREGGLSYRQLADKYDISHEMCRRICTKICYKEVI

SEQ ID NO: 7735 - protein, 227 aa, Acinetobacter baumannii
YGGCMMGGGGGGGQMGGGNLYQAIATAAVKGATTYLKLKALKQSLEQQADIAGENATLADIQARDAIDDGRNSVTDYQRNLSGFKSSQINALAENGIDVTQGSAIDILASTEMMAQNDIDTLKYNAAMKSWGHRVQETNFINQKNSLLAQAKSVRPRLNAELAAIDQFASSMMGGGGGSPMQGGESLTMTQPVNGSYNANSNFSMSLYGKEQGASWQNYNWNWMGAA

SEQ ID NO: 7736 - protein, 382 aa, Acinetobacter baumannii
AHRLAIGRMMNSPNVNSYHPDLVVEEAKNGWRIVRLNRPKSLHALDESIVTALLRVFEDFRDDEQVKAIWLDSTTPKAFCAGGDVRKLRQLVINQEVETANKFFQQEYALDLLLHNYAKPVVVWGEGYVMGGGLGLFMAAPFRLVTPYSRLAMPEINIGLYPDVGASRFLADRGQIGLFTGLTGSIMTAAGAYSIGWATHICEAQRDNVLQKVLNINWAHYPAGDFRAIDDTLNSLHRPVAAGPLQNSLDVIHSVCRGSSFEQDYQAIVSLRDASSDWLRQASENLQKGSPSTAAITWLLWQWGKQVHSWDEVFDLEAQISEWKIRHPDFVEGVRARLVDKDLSPEWKACEDLTLRGILADDPPITTIDSWNALLRQYGVVS

SEQ ID NO: 7737 - protein, 98 aa, Acinetobacter baumannii
RNRLLNKQKLLFHEIKVFLGSGCTHDMYVNNEKVFSIRSNEIATIYLEPKYYIFRLETGGGMCPNIATSQETEVKPGAEIEYRILLPSDFNLRLTRMK

SEQ ID NO: 7738 - protein, 382 aa, Acinetobacter baumannii
RFGLYNRSIYFNGRRNSLSLKQHPDLREIIMKAARFYDRGDIRIEDIPEPEVTPGTVGIKVAWCGICGTDLHEFMEGPIFIPPCGHPHPISGESAPITMGHEFSGVVYAVGEGVDDIEIGQHVVVEPYIVADDVPTGPGDNYHLSKNMNFIGLGGRGGGLSEKIAVKRRWVHPISNKIPLDQAALIEPLSVGHHAFVRSGAKAGDTALVGGAGPIGLLLSAILKAKGLKVIITELSAKRKEKAKESGVADYILDPSEVDVVSEVMKITNGDGVDVAFECSSVNKVLDTLVAAVKPTGVIVIVSIWSHPASINVHSVVMKELDVRGTIAYVNDHQETIKLVEEGKINLEPFITQRIQLDDLISQGFETLIHNNESAVKIIVHP

SEQ ID NO: 7739 - protein, 79 aa, Acinetobacter baumannii
RDKCMRMKFIAYDPNSGEKLSLKEHIHHMDKYTTYVFFSDEKDNMVFNPQKKQIFEISQYTSNMMVEISRKLYYLIGEY

SEQ ID NO: 7740 - protein, 264 aa, Acinetobacter baumannii
IKECIMVNHQIKVLQALASAIAEGGRGVTGTAFPKQPVRALKLYEFEGSPFCRRVREVITLLNLDVEIYPCPKGGLKYRSIVKEIGGKLQFPFFIDENTGDKLYESQDIIHHLFKYYGKTGQTPDKFSNYPKMPYLAFAGTLLNGARGVWINKKIVNRAAPKHKLELWSFEASPYSRVVRSVLSELELPYILHSVAKERWQDMGPAILRLKPGKYEPLKEGKREKLLPLMQGKMQVPYLVDPNTGVKMFESAEIVKYLKKQYGS

SEQ ID NO: 7741 - protein, 63 aa, Acinetobacter baumannii
LKRCKMLKSILVLGTGIAIGMCMYKKKQKNSKSFSTDSDTDSLISKDNNKSKDDNSLDNAVQV

SEQ ID NO: 7742 - protein, 507 aa, Acinetobacter baumannii
MNFRQIQAILHSWFGIIVLWVIFFIFFTGSIAYFRTEINVWAQPEAISHIQTIPSAQHSAQTAFNYLNQHAPNAKRWRVTVANERMPVNLLQWQDKEGKHQELQNPNTGELLGPVRKTLGGDFFFKLHYTLYPLPSTFGSLVVAVVALILLISLITGVITHKKIIKEFFTFRAFKGQRSLLDLHHITGVITFPFYLVMAFTGLLILFYLVLPWGLSEQYGKAGIPKFYNEMQFTEVAKPREPSLTEAMQPFNQFMAQMPKRTESGAILDKFEVQKPNTADGVITFDYNYKNIITLNTPQYIFATNTAERLNQPRNLSAIAQLGSSSYGIHLGYFASIWMRFILACLGIIGCVMLVAGALLWQKKRIKEQKKFGYRLVQHLNFFTFLGLPFASAFYLMVGRIIPASFEPRELYEVSAFYIAWLLSLLISFSCSIRKGIIIMLYITAAVLLLIPVISVVLVPEASLLNSLKSVHWSLAGVDLALILLGLFYLVVLRFYQTKFITLGEAK

SEQ ID NO: 7743 - protein, 248 aa, Acinetobacter baumannii
RHFRVPFYLVYRINTYKIRDVKVQYFIPAMCANFKPLTLAQLQQLQLPVVGFSYADEVYPSGTMPLLFKSPQGFEWREVMFGLVPKWAEDTNIAKHTYNARHETIFQKPSFQEAALKCKFGVIPVTEFYESKYINDKPERWGVRRKDGQAFFIAAIYEICKMNETIVRSASMLTMDAIDHPMMKDFHEPGDVKRSVIVIPHDRLDEWLSLETPDISSFIEGFPVEEFECLHVPKEKIIKPTPQLSMFE

SEQ ID NO: 7744 - protein, 162 aa, Acinetobacter baumannii
HVYRIMRLTTRGRYAVTALLDLALQPTEQTITLAEIAARQSISVAYLEQLFAKLKRHGLVSSVRGANGGYHLARNADEITVLEIIEAVNETVDATRCDHKGNCQNGAMCLTHDLWQELSHHIADYLAKITLANLISRDNVQTVALRQNVTGTDSALLSGTGI

SEQ ID NO: 7745 - protein, 83 aa, Acinetobacter baumannii
IGSRSMNTSAVVVSLDQIRAVLESNTTNAHAEVMSLLEKPLLAETLIKTRGNQTKAAELLGLNRGTLRQRLKAHNILKTKVTA

SEQ ID NO: 7746 - protein, 461 aa, Acinetobacter baumannii
DSIFMSNQNDKLKSLKTSSMDRRLSIAKASLLAGTRWATASASSLFSSEEEKEKKRKKAMSEQANYLVSEIGKLKGSIVKIGQMMALYGEHFLPEEITQALNTLNNQTVALDWPAIKPHLQEQLGSKLNDLTIDHEPIGTASLAQVHRATRKSDGLELVLKIQYPGVANAIDSDMSLFKNMLKLTRMVPQTREFDQWFDEVREMMHREVNYHVEAATTRRFAERLKDDERYIVPTIVDEYCTDQVLCMTFERGVPINSPVMLSLPQERRNQLGEASLEIAVREIFEWGEMQTDPNFGNYLVRLGNGQDIQDKIVLLDFGAIRQFDEHLLSVARNLIQAGYQHDKHAMVQAMTGYEFFDAMPESIKPGMADVFLLATEAFSTPANNPDMPAGLMDEHERYDWKKSQLHSRVMQQASKSMASRYFSVPPKEFMFISRKFIGAYTFMTVIDAKTNVRRMIRNFA

SEQ ID NO: 7747 - protein, 128 aa, Acinetobacter baumannii
TRLRPLRVVSTGNRAMSICQKHNVMNDNLTWSFHMCSSNFTDLLFGGNSVIDKTAKLFGMDAKKADIQAPPKPPVRQDSKSPDASATIDRVQNAQNSMSGGIANTLYTDATGVDDENLRLGKKTLLGG

SEQ ID NO: 7748 - protein, 382 aa, Acinetobacter baumannii
LGIRHLKIPFGEISMKKLLLAAAVATLSVNAVQAAPTLYGKLNVSINQVDNKNFDGKSDVTEVNSNSSRIGVKGEEKLTDKLSAVYLAEWAISTDGSGSDTDLSARNRFIGLKTEGVGTLKVGKYDSYFKTSAGSNQDIFNDDTRLDITNIMYGENRLDNVVGFELDPKLLAGLTFNIMAQTGESTSDSKKGETGKDSKNDSFDSVSTSLGYENKDLGLAIAAAGDFGIKGKYAAYGLKDVYTDAYRVTGSYDIAKSGFVVGALWQHAEPTDDLTAYGQTYKSDGSIDKAGKAYRGLEEEAYAVTAAYKIPNTKLKVKAEYASAETQVSGQADRKIDLYGLGLDYQINKQARFYGIVAQQKRDWLNDDDKQTVVGTGIEYNF

SEQ ID NO: 7749 - protein, 481 aa, Acinetobacter baumannii
FGIRNMRQNKLINKKLLLSSLIGAMVLGTLGCGSKTETVRVAIGTQDTTINCATGGLLIRELNLLPKYLPKDSEYKNVKYDIQWKNFTSGAPLTSEMVAGRLDLGAMADFPAVNNLAAFKKAGKESIFLAPLSGSINGSGNAIVVPIDSKVTSLKELKGQTISVPFASTAHGLLLRAIQAEGWQLDKDIKVIAQAPEVAGPALKSHKIAAHADFVPFGELFAYQGFAKKIYDGSQAKSPTFHGSLASKDYAQQHPEVIKAYLQATIEANRLIQEQPEKYSEFIAEKTGIPAEVVYLFHGPLGLQTRDLTWKPEYRKATQIAIDTLKVLGKNDGTLDVNKFIDDQYIKDAFQASGLNYSQQLADYAKSPLVANDALTGQPIKTFDQVTQIWVKGEEKVRSYETPEHAFSDLKKIQAAGKTVRVVYSQDHQSDIKLLANLAWYATDKAGQIQAFLLKDDAEKWAKQQGGKVYDFKAIQLVTQS

SEQ ID NO: 7750 - protein, 135 aa, Acinetobacter baumannii
FLTRKEISGGSMTVMITLEPSRYIKRKGFGSENCKAIKQSVPFVEARRGEYTHRVRHVTLITTFQNKSHFAVHCWCGMTMCVGGTGKGTGILLDTPSANRPMCATCEGRVIGAGLIGSREISGRQVMYRASEVRS

SEQ ID NO: 7751 - protein, 355 aa, Acinetobacter baumannii
FRFRLLSRLRGMKMGHSVALNFADGKTFFISVNNDELLLDAAVRQGINLPLDCREGVCGTCQGQCETGIYEQEYVDEDALSERDLAERKMLACQTRVKSDAAFYFDHDSAICNAGDTLKIETKVTAVELVSETTAILHLDASSHTEQLQFLPGQYARLQIPDTEDWRSYSFANRPNATNQLQFLIRLLPDGVMSNYLRDRCQVGQSLLIEAPLGSFYLREVERPLVFVAGGTGLSAFLGMLDNLVDQPNSPAVQLYYGVNSETDLCEQQRLQAYAEQLPNFSYHPIVTKATETWQGKAGYIHEHLNKDQLAEQAFDMYLCGPPPMIEAVKNWLDEQALQNYRIYSEKFLQSNTSR

SEQ ID NO: 7752 - protein, 218 aa, Acinetobacter baumannii
ILLRCYLFMHPFFQELQQGSQKLGLSLSEEALTLLLKYQDALVLWNKAYNLTAIRDPKEMLVKHLLDSLSILKDLPAGRLLDVGTGGGMPGMIIALCQPERSCVLLDSNGKKIRFLKQFIADLKLKNVIAVQTRVENQDTIDELGQFDVITSRAFASLTDFVEAARPYLHEQSIIAAMKGLIPVEEMEELKQEFSCKVIELHVPRLDEQRHLLLLQRI

SEQ ID NO: 7753 - protein, 319 aa, Acinetobacter baumannii
SIPRYLSLVIEDEVMNILLYVAVVLIWGTTWIGIAVQSHYATPVVAILWRFAISALLLWVVLLFSGKLQRIALKDHLFCMLQGLCVFGLNFICFYTAVKYVNSGLESVIFSMAVFFNAINALIFFKQKPSPNFAPAALLGLSGIVLLFWHDLINSQFNAQLLMGIGLCAIGTYGFSLGNMISVRHQKRGLNIFSTNCYAMTYGALVMLILALFTGQDLMPPMNFPFLSSVLYLAVFGTVIGFSAYFSLVGRIGAAKAAYSTLLFPLVALTVSTFFEGYEWTLNAVFGILLILLGNYLMFSKFEIGKKLFSSQKNCEKQA

SEQ ID NO: 7754 - protein, 441 aa, Acinetobacter baumannii
KVPSFCLQSDGRNMTYTQEEKRSRIRGIVGAASGNLVEWFDFYIYAVFAAYFTQALTAPDMDSTTKSIYVWGVFAASFFMRPIGSWLFGRIADRHGRKKSMIISICLMALSSFLFAALPTYDQVGLFAPFLLLLVRLLQGLSVGGEYGAVATYMSELGLKGQRGFYSSFQYVTLSGGQLLASLLGVILLTFLSEQQLHDGGWRIPFVIGGIAAILSLLARSRLEETLSHQDSERKESGSLRELFKKHWKTFLLVVGYTSAGSLTFYVETVYSKTYLTNLGMDGKTVGYIMTFALFVYMCAQPVFGAISDRIGRRSSMLAFSLLSAIFIYPVMVIGMRAYIDSPIIITLLLIFMMMLLSFYTSISGLVKAEMFPPHVRALGVGFSYAVGNALFGGSAPSVALQFKAAGIENTFFIYVIVMLIICFLCSLALPKKPDYLEHDH

SEQ ID NO: 7755 - protein, 259 aa, Acinetobacter baumannii
TCYSGKILRKDDKIKMALDLLPKSMFEAIDLLPDASTPVTLFTRHSLRELVDGQGLAGYDLQLTPQGRELAQEWGSYLIKNTDRVIQHCISSPIQRCVDTAALMIEGADGVSPEPNTHTIEIVEQGLLVEPGSFVLDIQQAAPYFRKQGALGFINSFVNNALPGMKHPITGVLDVLELIYQTHPKTKSGLSLAVSHDTIIAAIVAVISGNNQIQKADWPAMMEGLFVWFEGDEFPNCKLKWIWRGKTYELDVSEFHKVQ

SEQ ID NO: 7756 - protein, 599 aa, Acinetobacter baumannii
IGCSQMQELANRLAIQNFVNAYMQETGKGYLLSFDQQSSTQQAFSSGLTLLTLPLPSIQAECSVPLSYVSRVGRHRLAALPKMCIDGQWQKISAGTIVSLLLEELVIESQFKLDAASLLEKWIQSRDALLQFLKQRHNDFDDLVKAGQNFIESEQALILGHSMHPAPKSRNGFVHEDWLKFSPEHAGKTQLHYWLVHQNYIAEGCATEQPISDQVKDAIRWYLSESDLNLLKTHVEFKLLPLHPWQARYLQGKPWFEQLKQTGQLIDIGLRGWQFSPTTSIRTLASFNAPWMVKTSLSVMITNSIRVNLAKECHRGEISYRLWHSELGKKILKQCPTLKAVNDPAWIALQIDGEIINETICIFRDQPFAVQQQVTCIASLCQDHPNKELNRFNALFDQIAQKNQQTNFKEIALDWFDHFLKIGLAPLMYVYHKYGMAFESHQQNVLLELEDGLPKNLWLRDNQGFYYIEEFATEIVEALPDLLEKAHAVGPKDFVDERFSYYFFGNTLFGLINAIGATGYISEDELLIHLQQNLLQLLEQYPDSTLLQGLLFNDSLPYKGNLLTRLHELDELIAPLEHQSVYVQLPNPLYVEQKDVSYA

SEQ ID NO: 7757 - protein, 474 aa, Acinetobacter baumannii
FWCRRTRMSKAQFDLIVIGAGPGGYVAAIRAAQLGLKTAIVEERHLGGICLNWGCIPTKALLAGAELATQFKHAGQFGFQVSQLDFDIQKLVQHSRQVSAQLVQGIDYLLKKNQVTVFSGRAQLTAKEKIEVTDAQGNSQALSAPHIILATGAKARHVPQLPVDGTYVWSYKEALVPEQLPKSLLVVGSGAIGSEFASLYQDLGCQVTLIDLAKQILPTEDAEVAQFVRKQFEQKGMKVLTDAVVQSIQIENEQVHCVVETANDVQTLVFDCVLSAIGVQPNTTGLGLERLGVELNPQGFVAIDDYCKTNVAGLYAIGDVAGAPCLAHKASHEAIICVEKIAGVANVHSLDRSQIPGCIFTHPQVASIGLTENAAKAKNLPIRIGKFSLTANGKALAIGDASGFIKTVVHAETGELLGAHMVGHEVTEHIQGFAIAKYLEATDESLAQVIFPHPTLSEAMHESILASMQRAIHM

SEQ ID NO: 7758 - protein, 285 aa, Acinetobacter baumannii
RMSSLVQTKPKNQSTFLIKFFQQLRLYPAHLKNYAIAFTSIAFWIVIWQGLAQFKINLGIVNFSNVPTPLDVIHALWTFFQLSTAFEHVESSVFRVVVGFVLAALIGVGIGLLAGRYQKLAAFLMPPLEVLRPIPAVAWIPLAILIFPSSEASMIFITFIGALFPILLNTVHGVGAVDPRLVASAKSLGASDLAIIYEVIIPGALPNIITGLSIGMGTCWFCLVTAEMISGQHGIGYFTWESFTLQNYSNIVVGMVLIGALGMFSSTLVRVIGNRFTPWYQLRKS

SEQ ID NO: 7759 - protein, 404 aa, Acinetobacter baumannii
YMTSKGEHLMNQSDDLEYQLDTLAIRTGHTRSFEGEHGEPIFLTSSFVYENAAEAAAKFSGQVQGNIYSRFTNPTVSMFEKRLAALDGAERAVATSSGMGAILSIAMAYLKAGDHVICSRAVFGSIVALFEKYIAKFGVDITFVDLRDLDAWKNAVRPETKLLFVESPSNPLAEIADIQALADIAHANGALLAVDNSFCTPVLQQPLKLGADLVIYSATKYLDGQGRALGGAVVGNHQLLEEVFSVVRTLGPSMSPFNAWIFLKGLETLRLRMKAHCENAQKLAEWLSTHEKVEKVYYGGLPTHEGHELAAKQQNGFGGIVSFVVKGEREGAWKVIDNTKFISITGNLGDVKSTITHPATTTHGKLSAEAKQAAGIEEGLIRVSVGLEDINDIIGDISRGLDLI

SEQ ID NO: 7760 - protein, 238 aa, Acinetobacter baumannii
ENNRMNKVYANAEAALKDVIADNQTLAVGGFGLCGIPEKLIVAVKQSGVTGLTCISNNAGVDDFGLGILLQTKQIKKMISSYVGENKEFERQYLNGELEVELTPQGTLAEKLRAGGAGIPAFYTQTGVGTLIAEGKEERIFNGKNYILEESLTADVALVKAYKADTAGNLVFRKTAQNFNPECAMAGKITIAEVEQVVEIGELDPDEIHLPGIYVNRIVLNASPEKRIEHKTLSTEAV

SEQ ID NO: 7761 - protein, 82 aa, Acinetobacter baumannii
GLNRLKPIFLSSYQFPLCLPFCRFLQRYIPKNIALHKDYEKYNSSSIDDWNAAVLFQRAIYMKQKLYHIKKFSRYESFYLTF

SEQ ID NO: 7762 - protein, 73 aa, Acinetobacter baumannii
ILCRANVILKYANAIPRKSNSFMDGLVTGSHKVILCKRTKLATFITLLCILFSGCTAHSINNNIQVSLCVKAI

SEQ ID NO: 7763 - protein, 2188 aa, Acinetobacter baumannii
QHLRLQITVVLSAFIMSDQNTNLTIGQLFELNQGKNPTQIADTEARARKAARSLGLDYNKMTETPEQIVSVADEINTQKRVNDVVASDPVLGKYALNPNQAAVSLDDFENLKDISDKVSLLGSSLNKPYEPVSYQDIQNVLSKGTSPEQKKRLKELGIYEDPQKQVKPNVNPNLLDTLSTSLVPQTSDQVFKEHYDRIKKTTGVMAAERFKKYYENQVYWMEHTATAEPTSPQEQGNRYVNAAIRAVAAIGQTEGAVISATTGNDSLLNLATRVKNKAAPSQEMTQALYQAQLAAQTNDAGVLGAAQELVSNADAGLVGEFLIEQAPPALVGYYAGAGAGGVLTNSLIRNTAKYAPMVMNLEKAAKLVRGVTTAGNAAQGALGAGTADALVSYGQNMAEAREKFLTRQEQIDYAAAKTWGSAKYSALGGALMPVTFGGPLRTVGGQAVIQSAAGMYSVKGAADAVGEKADPVEMALEGLLEVATAAPEVAITSAAKVKNQRTAQFALDQLRQDQQQDAVRSSTFAAVLNNLIDRNKESKTAQRDDSASQAFIKQAVEEHGAVEEVYIDGQTFNQLLRDRNIEPTDLFERAPSLQDQLGTAETFNGTVQIPVNEFVSAMSVVERPTDFVENVRSSPDMPTYREAQENLAKTTEQMQQEAGTYMAEQARFESAEDAKELVATEVQNQLAKVGTFTAKYNRAAGELTSAFYSTLGDKLGISAKEAFDRYPIRITDDSVQSEAKAPESVDNDVTLIQTQQPKTEPKGQRYQQSKGGTRGSITFSIGQDGSTIVLSKNADFSTFVHELGHHFLEMNMQLALSPDAPAQVRADMETVMKWASPETTDLGEWDFFTDAEKTEVHEKFAETFEQYVFTGKAPSAALKQVFNRFRQFMIAVYRNIEKFMGINDRAELNADITGVMDRMLASSSAIAEAQAASNLEMLIHQDDAMRLGISPKDYDEMRQDHEIATELSINTLEQKSLRNMVWYQKQKSKYLKTLQKEADKKRAAVREDMAKEIAQEPVYQAMAFLRQPLDQVAKRDSTKVEPERDNLFEAIAKFGGLNANEVESTWGIDDAAKTKSGVGNKPVVRSSKSKVKGLSIESMAEKLSEEGYLTLDEHGKFDTRELEDKFAEQLRGVNQYSNQVDPELLDYSQDMDLLQRYAEGRTTKGKLSLDWIEAKYGRDSDIYQSISKGAYGFAQRGGENPDVVAEMFGYESGDALIRDLLNSPSPKQKIDELTDARMAVQYSEFFDQQSIIEAVEAALHNDVRARMLSAEMAALNGLLGRKSALNEAAKTVAQDIVQRQKIKDIRPHVRAQDDARLGRMANEAFRKGETVEAARHKRNQLVQFYATKYSYDAKDQTQKHLDLVKKVFGNNEKLSKNRDFDFVTAARGILGKYDLGRESTNYEHQLELIRKYDPTTYAEIQNIGALPENQNYRELTLEQFNAVMAAVETLWHRSKENKIWHTTNEAFEREQVREELIQQTGGKKSVEKIQQTLLGRDKTAELKAKFMELGASAKRVDQVVTWLDGGANGKFRTYLINPMQDALAKYRIEKAKMLKDVVDIFEGFGKLDNSKIAAPELNNFTFVGKQSLLHAILHTGNLSNKERLVLGYGWGARLEDGSVDFSAWDQFFSRMVKEGVITKKDMDNIQKLWNLFDKYKEQAQITHKKINGRYFDELPRTPISTPFGEYEGGYVPAAYDRIRSNEQDRIQDKNLAENNLAALDIATTGANFTKSRADRYHDQLELDMSRLPSHLDKELRYIHLELQIRQIGRLLLNKDFRNEIERVLPFGVKQVFNPWLKAIANQTVDESSGVSLLDNIFRTLRRNTGIAIMAGNLKNAVEQFTGFTQVAVAVPPKQLLKAQAHYFASVATREDMANNIMEMSDFMKTRFDRAADEYRYAVDEIVFQKGAIQTVKDFTMKHAYVLQTTIQRPMEMISWQAAFNHYTEQGMTQYDAVHAADAVIRQYMTDMSPEGISNLERGTPAKRMFLMFYNWFNMVWNTSMSEAKLALEASNGSWVQASPRLAYVALMMISIPSMLSELLGVIFAGGLKDEDDDDNKWDDLSAKLALSQLKMLAAFVPYAGNVVNAAISNTDDTIVNDRYTASPVFSMGESGLSLIQHARRALDEDKEVNQGKASKDLMNTATLVTGIPFAVLGKPSGYWLDVAQGKKDAPDSIYDATRGTITGKHAPE

SEQ ID NO: 7764 - protein, 340 aa, Acinetobacter baumannii
GPLSMSLARLIQNAWNKQSSWLIVLRPLSCLYRAGFLLNRGFYSSGFKKVYTAPVPVMVIGNITVGGSGKTPLLIELVNYLKQHNVKVGVISRGYGGAGPFPMLVTSASQAAEAGDEPALIVQSTGVPMAVGPNRQVAIELLLASTKLDLIISDDGLQHWALGRQIEWIVLDQNRGLGNRKLLPEGYLREPVERLKTSTVIEHTFTPTTTLHMHLDAGQPYLLNPSSATELSFNIQNNYHAVVGIGFPQRFYQTLKGLGVKQFQEHAFRDHHDYSIDDLLFNDDQPIITTEKDAVKLLPLLEKHPEFKRPIWVVPVKAVLSTECYQVLNQQLQKLDIQIS

SEQ ID NO: 7765 - protein, 477 aa, Acinetobacter baumannii
LIRSLMMNADITTRIEKDLIGHREINNDHYYGVQTLRALENFNLTNSKVGNFPNLIKALAMVKLACAEANYNLKNLDQTKFEAIEYSCNQLIRGNFHDQFPIDMMQGGAGTSTNMNANEVLANVALEYMGHSKGQYQYLHPNNDINMSQSTNDVYPTAIRLGLLLSLDELNLPFNNLILSFLNKSQEFAHILKMGRTQLQDAVPMTLGQEFGAFAVTLQKDLEQINTLIPNVLAYMNLGGTAIGTGITTEYSYRELAIQALGKISGKKIKSAPDLIEATSDMGDFVLLSGLLKRTATKLSKIANDLRLLSSGPRTGINEINLEARQPGSSIMPGKVNPVIPEAMNLACFQIIANDLAVTLAAEAGQLQLNAMEPLIAFKLFESMDLLGKAMAMFQTKCIDTITANPEHCKALVENSIGIVTALNPYLGYETTTRIAKTANETGQSVLALVQNEGLLSAQVLDDILSINNMVKPKMSA

SEQ ID NO: 7766 - protein, 128 aa, Acinetobacter baumannii
QNGRLNMMLYGYHFSTIENNWEDLTPLNEFLQTFADDDGDVSQRDKESLKEIIAKSDTALALAKEMGWDGSYTGCPYLFWLPSKNTQSFEYGFVFKQTSDNSTFVISPIELAYLAQDEQVQTLSKNID

SEQ ID NO: 7767 - protein, 525 aa, Acinetobacter baumannii
SVLSKLCEKHWRLRMSEIKTLEIPKWGLSMEEGTIAQWLIKEGDSFNKGDEICEIETTKIVNVLEAPFAGTLRKILAKDGDTLPVGGLIAVCADSEVSDAEIERFITSLGGSAAQAPEAPSEQSKAETSAPVAEKAEQPQTVAASAPVPAKVAKDDYAVPESLQGYQTSDELFATPHALKLAEKHNVNLAKVTGSGREGRISVQDIQKAVQAAGGQWPDIKQQTQAKVFKSTADDSQVLATPVARRLAKQWGINLNDCRVSGTRGRVCKEDVEAVYYRNNPTSVNEQSVQYAAQPQSTITTVAMNGMRKAIASRLQAAKRNAPHFRLVVDLNVEALQKLRKQINETVPQVKLSINDMLIKAAAAALIKVPEVNVQFDEATQSILQFSQADISVAVAIPNGLITPIVKAANQKSLAQISDDMRDLATRAKTGKLQPDEFQGGSFSISNLGMLGIKQFDAIINPPQGAIMALGASESRAVVENGNLVVREIVTATLSCDHRVIDGAVGAKFLASFKQFVENPALILV

SEQ ID NO: 7768 - protein, 217 aa, Acinetobacter baumannii
TFMSETQQRQKHPRLLLNIVLIILETFFSFILTHDGVLRLQAKKFIANKITIRINSYLPFFDFYVQFTEKGLLFDIHSYDRRIDLEINSTLVDLIKIFVFSNQRSLNNMRIDGDAETKKELIDLISHLTLPKLLADWKQWFNAPDDEAEALASRKKIAPLLEKIDQQRSEINSLHVEIKQYQNRIARLQQRQRNINLCFGIISLIFIVYFIYNLWVA

SEQ ID NO: 7769 - protein, 296 aa, Acinetobacter baumannii
GGMSNQDVDIWMPIYIGDMLAKTTRMTTEQIGASFLLMMDYWRNGAIPDDNNVIASVIRSNLSKAKALKTILINSNLFEVKDSELSSKYLDDLKSQAESNKSSKSERAKKAAEARWNKEQDSSNTNASNEHQSSNANAYAQAMHKHDSSNAQGMLETCPSSSPSSIYIHTQSETPNSLDEDLSLWKPSLHEINSWRQRAGLPKTTQEEFDTFMITFLPHYAPEIRSGRLIENKIYAKYIQWVKDDALKANRLAKAKPAAKTNSANDSRNVNDAWKDEPKSDDRPFTGTVHIPEDLI

SEQ ID NO: 7770 - protein, 294 aa, Acinetobacter baumannii
KSMSELNNIAETNYKLGQTSLQNVTQSTGVLPFVVVPNGSEVHEFEALLQRPLTLTQSVNLHTAKDFIAYVSRYADKNSLVFVDVLKGKFKAVLDYHEVEKETNTGSVLAPRHGKHAAHFIAEKTPEFQKVEGNSGRKFSQTEFALFLEDVMPYINQPDAAVLYEIVQTLNAKTNVDFKSGIRTDNGQVQLTYNETIEARAGTAGNLTIPEQIVVGIQVHRGGNHYALPARFRYRIKEGTIVFWYDLDQLEKAIEKSMEDTVEYIRDGKTITKDDQEIELAGLPNYVQILEGSV

SEQ ID NO: 7771 - protein, 478 aa, Acinetobacter baumannii
IRMRRIFSAMEKQQGIFERFALRISDWSEKWFPDSYIFALLGVIIVSIAALGIGAPIHDVATSFGNGFWSLIPFTLQMTMLIIVGYVVSVSKPVKFLIQKMARIPSSGRGAIVLVATVSLLISLVNWAISTILTALLVIALAKRKELNMDYRAAAAAAIIGMGATWALGISSSAAQLQANKTSLPESIYNLTGVIPFTETIFLWQSIAMTIILVIVSIAIAYWSAPKGNSVKTIDSFDVQFEEEKTNEAKSTRPGDWLENSPILTIIVVVLGLIWMFFEFSKSNPIIAISSLNTYNFVFLMLGLALHGTPRNFLNAVAKAVPAVSGILIQFPLYGSIAFIMTQALNSQDLSLSHYIAEFFVSIASKETFAIVMGIYSAVLGFFVPSGGGKWIIEAPYVMQAANDLKVHLGWSVQIYNAAEALPNLINPFFMLPMLGILKLKAKDVIGFTVTQLVVHFPLVLFLLWFFGRTLSYTPPTF

SEQ ID NO: 7772 - protein, 407 aa, Acinetobacter baumannii
FKKRDNMQHQINGIALPNEQGFFGEYGGQFIPPHLKEAMDEINVAYEEIRHTPEFQNELADLFANYVGRPSPLFHAKRLSEQLGGAQIYLKREDLNHTGAHKINHCLGEALLAKYMGKKKVIAETGAGQHGVALATACALVGIPCEIHMGQVDIEKEHPNVVKMKILGAHLVSVTRGTATLKDAVDSAFEEYLKDPKNFIYAIGSVVGPHPFPKMVRDFQSIIGKEIKEQTHQRFGKNPDYVVACVGGGSNAIGAFTAFLNDSDVKLVGVEPAGHGLDTNMHSATLTLGKPSQIHGMACYVLENEAGEPLPVHSIASGLDYPGVGPQHSFLKDLGRVEYSTATDQECLDAFMTLSRVEGIVPALESSHAVAWAIREAPKLPKETMIVVNLSGRGDKDSDYVAEKLKL

SEQ ID NO: 7773 - protein, 283 aa, Acinetobacter baumannii
IHFGFNATSDSYVEILHLQELNMVKGLKNKVALVTGAAQGIGRGIALRLAQEGAHIALVDMKQDRLNDVQQEIQALGVNASTFIADVSDREHVYAAINHAEQTLGGFDVMINNAGIAQVQAIADITPDEFQKIVDINIGGVLWGIQAAAAKFKQREHKGKIINACSIAGHDGFALLGIYSATKFAVRALTQAAAKEYASHGITVNGYCPGIVGTDMWIEIDKRFAEITGAAIGETYKKYVEGIALGRAQTPDDVAALVAFLASEDSDYITGQSILTDGGIVYR

SEQ ID NO: 7774 - protein, 86 aa, Acinetobacter baumannii
PNYGVFRMKYLVIKKLGHGFYLGKGNVRQGGKEFIVIKSDKELLVGAESYKYDASNNQLLWEGIQNLGQEVVGFADTEEEALDLAF

SEQ ID NO: 7775 - protein, 101 aa, Acinetobacter baumannii
KPLGISKKMQQMLLKSILIFKKMEVLKVRSGTLYLKNYPSSESKLGFVFIEKMLDKSPHIEGFFMPKFRFLLNAHSAMLLTLARIPAHLLGLTLDLNDRQE

SEQ ID NO: 7776 - protein, 116 aa, Acinetobacter baumannii
GVKGKEMHIQEISNDPNSNKLLVGKLLENMSTRVPVEVKQLIDDIANSNGSDRAKWMREAIDLKLKVDLGISSTEELVETRNTTKSSEYRNVFRNLRAFLHALKKPDVAGRAFRVH

SEQ ID NO: 7777 - protein, 301 aa, Acinetobacter baumannii
AIILSCNSFVSDHNLNFYIHLLLIRMIIICNYIYRFLYNINWSIHMRSTIVVTGAARGIGAAIAKQLLDQGYHVIGIDCQKNPEQWDISKTMTSDQSSQWQGISQDITHQQETQTLISELLEKYEITGLVNAAGVLIMRSMLEAKTEDWETLFAVNVMAPIAISQQVAKHFCAKRRGSIVTISSNSARMPRMQLGMYATTKAALSHFCRNLALEIAPYQVRLNIVSPGSTLTQMQQQLWTDNTPPPAVIDGDLSQYRTGIPLRKLAQPDDIANTVSFLLSDRAAQITMQEIVVDGGATLGV

SEQ ID NO: 7778 - protein, 85 aa, Acinetobacter baumannii
RLFFIYHVNHPFLSYVISCSNKYRIYSTVNTHHLCKEYLKIIKIYKKLNSVIQNILKTLLTQVNVQSFYEHPLTQPNHVLTLYKN

SEQ ID NO: 7779 - protein, 288 aa, Acinetobacter baumannii
SLFMFITTTRPNDALIEQLLPILEEASQILLQEYQNYSAGYEFTIQEKHDDSPVTQADLKVNRFLLKHLAEITPELPVLSEESDYSARHAWSSCWMLDPLDGTKEFIHERDEFTINLSLIEGRETIFSVIVVPCEQVVYLGYLKDLPFKYSFSQQQWYQYQKTPYSKQAPVQIGLSHSSKNPKYQKFIEPIERIRTVIRREAGSAYKFCMMLEGEIDIYPRFHPTSEWDTSSGQGLLESIGGGLLTLTGKPFEYNQRDTVLNGGFIAFRDQESKKIAFEALAQSGVLD

SEQ ID NO: 7780 - protein, 333 aa, Acinetobacter baumannii
SILIAHYNFIKIMIDHVNMDALSKFFDDIHLNKSEYIYIKAQGEWAFKTQDQSALLAYIVLTGSVYIQLNVSEKITARAGDIILIPSGKAHHATDSKATASKLVDPVDITPLFNGHRHDPIELGSSTAENTLLLCLRCQVDTYMAGPLINALPSIMHIQHENQATPPEWLQIGLYFLAVETQKIQPGHDKIIDHLVSILLIECIRDHIQQMSDQQNWLGALTHPELSNALSAIHSQPEISWTVESLAEQCCMSRSKFANLFNSIIGEPPLTYLQHYRFRLASQYLRTSNLSIQQISNKVGYSSETAFSQAFKRVFDLSPKQYRQNYIGTNLDE

SEQ ID NO: 7781 - protein, 721 aa, Acinetobacter baumannii
MRIIYIIFNLMNIPPRPFKLSVIACAICYANLTYAQDAQVQALQTIQVKASNAEQSSEQTKAYNVKNSSSATKLNIEAKETPQTINVVTRQQIEDFGLTSTRDVLRNTPGVTVSNQETERTTYMARGFEISNILTDGVGFPLSGYNYNNTNPDTYFYDRVEVVKGADSLTNAFGDPSATINNIRKRPTQEFQASGGVSYGSWDTQRYEADVSGSILPSGKVRGRIMGYEQTGDSYLDRYSAEKNGFAGIVEADLTDSTLLTAGYSQEQNKPNANNWGALPLLDANGKQISYDRSYNPNPDWAHWDNETQNAFVELKQKLNDQWNAKLTYNYLDTKHNSRLLYYYGYPKSDGSGVSLTPWGGQEHQEKHAVDFNLEGTYKLFNREHEATLGYSYVRNHQQDKQSTGTINDSNVIKSTTTDWASWTPQSITWSDFTEAANYKQNINSIYAATRLHLNEDLKLLLGANYVQAESKGESYSSPMSYSESKVSPYVGLTYNFTPEYTGYMSYTSIFRPQTGIDKDTNQALKPIEGKSYEMGVKSSWLDDRLTGTLSVFKTEQNNYPLRNSDGNPLNRKVPTSDLESQGVEVGLSGQITDNVNLSFGYAQFSIKDTKNGGEARTYNPNQTLNLLTTYTPPVLPKLKVGAGLQWQDGIKLYDSNVNGTIKQDAYALVNLMASYEVNDHITLQANGNNIFDKKYLNSFPDGQAFYGAPANYTVAVKFKY

SEQ ID NO: 7782 - protein, 127 aa, Acinetobacter baumannii
VNVMPTKNTSFSQTLANLQRGDTIEELDALLTEALQASNDTGKVSKITVTLTIKPNGRGTYKIQDDIKSTLPKFDKEPTVLFTDGDQQLVREDPRQQKLNLEHIDAGTPAELKQIPTENKPTIKSLS

SEQ ID NO: 7783 - protein, 375 aa, Acinetobacter baumannii
DKVMWQQLITWLKQLSFLVKKEFLTIFSDPTNRAILFVPALMQALLFGYAATYDVNHVDYAILDQSNGQISHELISKLDGSGIFKRVATLEYTEQIKQVIDNRQALLIIAIPNDFESKLNNNQSAPIQVIVDGRNSSTAMVAGSYLNKIIGQFNQQKFNSALPISLETRTWYNPNQESRWSLMPALIAALSMMQTLLLSALSVAREREQGTFDQLLVTPYTPLQIMIGKALPPIFVGLMQSTIILLIILFWFKIPMNGSIGLLYFGLFSFNVAVVGVGLSISALSLNMQQAMLFTFLLIMPLMLLSGLLTPVENMPKALQVATYANPLRFGINLVQRVYLEGASFAQVKLNFLPMIVLGIVTLPLAAWLFRNRLS

SEQ ID NO: 7784 - protein, 482 aa, Acinetobacter baumannii
YLFFREKEYMWELFVILLSLGLLMYTAYKGFSVILMAPICALLAVLLINPANVLPFYSGVFMPKMVNFIKDYFLVFLLGAIFGKVVEMSGIAESIARTIVRWIGAKKAILTVVLLGAILTYSGVSLFVAVFAIYPFANQLFRQANIPKRLIPGTIALGAFTFTMDALPGTPQIQNVIPTTFFGTNIYAAPFLGIIGAIFVLCMGLAYLEWRRRAAAKAGEGFSGFGVNNTPSQEIEADINLQNNGSTARQFLAFVPLILVAVMNKYLSKAIKEWYPNGFDFAAVGLADYTVDVAKTGAIWAVGLALIVGIISAILFDYQRVVTNFKEGINASIGGSLLAVMNTASEYGFGAIIASLPGFAMISHAMSSTFTNPLVNGAVTTTVLAGITGSASGGMSIALSAMAEQYNAAILAAGIPPEVMHRVVAMASGGMDTLPHNGAVITLLAVTGLTHKQSYKDIFAVTVIKTLAVFVVITVFTVTGIV

SEQ ID NO: 7785 - protein, 333 aa, Acinetobacter baumannii
NGILYMDLKRQIETGIKLRGIDKVSRIPIKILPTEELPKKPEWIRAKITDFEEIQRIKNLLRQQKLHSVCEEAACPNLPECFGGGTATFMIMGDICTRRCPFCDVAHGRPMPLDENEPKNLAETVANLNLKYVVITSVDRDDLHDGGAAHFVKCIEEIRNRCPDTLIEILVPDFRGRLETALSTLSLSPPDVFNHNIETVPRLYKAMRPGSDYQHSLNLLKRFKKYCPDIKTKCGLMVGLGEIEAEVIALLNDLKDHDVDLVTIGQYLQPSKSHAPIHRFVNLQEFERYTQHGQRLGFKNIWSAPMVRSSYFADRQYFGEPAPKPFSREDVLS

SEQ ID NO: 7786 - protein, 639 aa, Acinetobacter baumannii
DLSMNALQPVYQVMDQGILQDFINSLLVETIIPEHFIFDFATAQTALNQHGKNLQEVFKNTSEQVSFVLLHEESRQGLVMFAVQKGITQAWKLANGTEVFLLERTNDHVQINVIGIIELFEFIQAIGLFNQCSTDKVQAFYEQLQKCLKQYHLLQQHRVNAHDLLNQSSAHRFRILEQYAGYRDRPYHPLAKLKEGLSQQEYMQYCPEFAQELSIHWVAVHKDKMMFGEGVENIFKQQPSEIFIPRAERYQLKQEMFQRGLNETHIAMPIHPWQFEHLFPKFYADDIADGVCHPLNFISKGMYASASMRSLLSKNVLEESLKLPIGIKALGSLRFLPIVKMINGEKNQKLLQQAKAKDAVLKLKLWLCEETQWWSYLPEKQNDRTADNEWLFVEKPTHLAAQRRHIPAELLQEPYQLIPMASLGHTITGQPAIFDYILQLQHKDINSKQILIEFEKLCTCFFDVNLRLFRLGLMGEIHGQNICLVLKNGEFDGLMFRDHDSLRIYLPWVEQSGLKDPNYLSPHDFRNTLYHESVEALLFYIQTLGIQVNLGCIVDNLASHYQIEVKDLWSVLAHALQQVIQNLNFQPEILTQLQHLLFEVPEWPYKQLLRPLLEQDTRIGSMPSGIGKTRNPLWYALNC

SEQ ID NO: 7787 - protein, 119 aa, Acinetobacter baumannii
TKSMKEQNLKLQIRILLEQNIAFGPGKADLLEAIARTGSISQAAKSMNMSYRRAWQLVDTMNQCFETALVETQTGGTHGGGAAVTALGQKVLQHYRQMEINARQALEHDYQIMSSYLKR

SEQ ID NO: 7788 - protein, 232 aa, Acinetobacter baumannii
IMFFKQFFEQESSTYTYMLGCEETREAVLIDPVASDIEIYAKELEQHQFTLIYTLDTHVHADHITAANLLRERFHCKSVLHRNSEVSCGDILITDGCMLKVGNLSIEARYTPGHTNACTSYLVGNMIFTGDALLIDGCGRTDFQQGNAGTLYDSIHKQLFSLPDDTIVYPGHDYKGRLSSTIGYERLNNSRLGQNRSREDFIKLMNNLNLPYPKQIDKALPANQACGSTSQS

SEQ ID NO: 7789 - protein, 145 aa, Acinetobacter baumannii
VVPMSKIIIGIDPDLEKSGVAVLGQSHFELKNLNFAEVVELFKAEQDLIKKVVIEAGWLNKKANFRSGANKSIAVNEQISRRVGENHATGKLLVQMAKHMGLAVIEVKPTKAKINSEDFKRITGWQGRTNQEQRDAGMLIWGMWV

SEQ ID NO: 7790 - protein, 222 aa, Acinetobacter baumannii
KMTISTKKAIVVGATGLVGLALVEQLEQTPEFEAITVVVRKESQLLNTYKKVTQLVIDDFLLLNDEDVNGHTHAFSCLGTTLKIAGSKQGFYAVDYEINAHFADLIQDKHIHFLIVSALGANANSPIFYNKVKGELEDYIQSLGIEKLSIFRPSLLIGKRSDVRFIEDLGQSLFKLIENKWTKPFKYKPVTAEQLAHTMVVAALTQIEAFKRYDNLSIQQTR

SEQ ID NO: 7791 - protein, 403 aa, Acinetobacter baumannii
GLYMLEFFSRLSLVTKIIIAIILGIGVALLFPTVTPYLSLFGELFIKALKSVAPILVFVLVLSSIANFQVGHSANLRPVLLLYVVGMLLAAFSAVIASLSFPSTLYLNTVSHNNLQAPGSLADILKNLLLSFIANPVQAISEANFIGILAWAIGLGLAMRHSSDTTKQVMQDVSHAVSAIIHKVIAFAPVGIFGLVAVTFADAGLATLESYAQLLAVLLGTMLFVALVINPILVGLTIRGNPYPLVFKCLKESGITAFFTRSSAANIPVNLDLAERLGVNPSTASVSIPLGATVNMAGAAVTITVLTLATVHTLGIHVDLATMIILSVVATISACGASGVAGGSLLLIPVACSLFGISSEIAMQVVAVGMIISVLQDSTETALNSSTDVLFTAAVDIRSRQNS

SEQ ID NO: 7792 - protein, 144 aa, Acinetobacter baumannii
VRYMINIGSCLCHKVKFSVPCEIKTVYHCHCSLCRKQTGTGANAATLVKENQFNWLMGKEYVATYKKETGFTSSFCNRCGSPVPNKINGTNYMWIPLGLLEQPFKPDLKLNFCIESKHDWVVLGDAHKNFAHLPELEEFLKYFE

SEQ ID NO: 7793 - protein, 266 aa, Acinetobacter baumannii
AFNMLLLVVEGIVIGFLLGLTGAGGGILAVPALMTSQGWSVAQAAPIGLLAVALSTLIGTIEGLFKKIVRYRAAIWIALIGAPMAHIGILIANTISPIWLMLMFSLVMFTVGYRLISNRVSDFHNPPCQVNPSTGRFIWNFKTGGVLASIGIIAGLLTGMLGVGGGFVIVPALRKVTNLDMHSIVATSLMIIFLISGMSIVMHIAEGFHYPVAITSAFALACAFGMLLGRRAIRFIPSAIVQKVFALMVFAVAIYMVIKIVNLTNI

SEQ ID NO: 7794 - protein, 135 aa, Acinetobacter baumannii
SSNILSIMSIHPDPQINRLNVLGEPLASCCFDPITGYFRNGFCHTAVTDLGQHTVCAQMTSEFLNFSQKVGNDLITPLPEAGFPGLQPGDFWCICVTRWVEAYQAAGQAPPVKLHACHQAVLSYVPLDVLMEFAV

SEQ ID NO: 7795 - protein, 115 aa, Acinetobacter baumannii
VINMPRIKVLPHAQFCPEGAEFEVEQNANLCQSLLNKGIKIEHACDMSCACTTCHVIVRKGFDSLEEMNDVEADLLDRAWGLEPDSRLSCQVKVVDEDLEIEIPKYTINHASENH

SEQ ID NO: 7796 - protein, 554 aa, Acinetobacter baumannii
GGNMELKRVNQEFYVADQITADDIAKIADQGIKTLICNRPDGEGADQPNVIEIEEAAQRHSLNVIYQPVISGKITDQQVTEFKQLYQNAQKPVLAYCRSGMRAISLWALAEVAPQDAALLVESGNKLGFNLKGLVPRILKRDHEPATIPCYSVVIVGAGAAGISVASSLLSREPHLDIVIIDPADTHYYQPGWTMVGGGIFKPQVTARSMTSVIPSKVKWMKAAVAGFDPEHNQVILEGCQPIQYKALVVCPGLKLNWHGIEGLVETLGKNGVTSNYRYDLAPYTWELVQQLNGGKAIFTQPPMPIKCAGAPQKAMYLSADYWLKQGKLKDISIHFYNTGAVLFGVKEYVPALMQYVEKYGTELHFNHQLVKVDGSAKKAWFKVVNDENAALVETDFDMLHVVPPQQAPDFIRASTLTDEAGWVSVNPQTLQHTQHANIFALGDVMNAPNAKTAAAARAQAPIVAVNVIAQLKGEQNFCEYNGYGSCPLTVERGKIVLAEFGYGGKLLPSFPKWVIDGQKPSRLAWLLKEQILPPIYWQGMLKGREWMVKPERG

SEQ ID NO: 7797 - protein, 484 aa, Acinetobacter baumannii
TEDMCMERSSVSAAQPYEQSLQRYVLLTVMLGTGTVSLNNSSFNPAIPHLMSYFQVGEVWASWVVVAFLLAMSISLPLAGFLSQRFGKRSIYLIALLGFALASTAGGLFNQFESVLIARALQGFCSGLMIPLSLGLIFSVTPSEQRGSTTGLWGAMIMLTLAVGPMLGALVLVWLNWKALFFINLPVACLALILGYVFLPKEQGDNKQEFDWAGFFFLGSSIVLLLGTLSQIHQIQDLFQPLYGALLVLSVLLFIRFIFVQKNKSMPLIEPALFATKGFRYSLVICVAQTVGLFIGMLLIPLWIQLLLKLSPLWTGFALMSSAVVTGICSQPAGKYLDRYGAAKIMSLGLMITVASFLLLAWAPIQNVWFIVFCMILHGLGMGLSYMPSTTAGLNSLRQQQQHLVTQAAALNNLFRRIFAAVAVVIAALYLQLRQQSLPLNTQAIFTSFHTMQEIFVCCAILILCTLPFAWRFPEQYRIDQLKK

SEQ ID NO: 7798 - protein, 159 aa, Acinetobacter baumannii
CDSISHYCLLSFIKDMFSLHPQLAQDTFFVGDFPLSTCRLMNDMQFPWLILVPRVPGITELYELSQADQEQFLRESSWLSSQLSRVFRADKMNVAALGNMVPQLHFHHVVRYQNDVAWPKPVWGTPAVPYTSDVLAHMRQTLMLALRGQGDMPFDWRMD

SEQ ID NO: 7799 - protein, 267 aa, Acinetobacter baumannii
IKSIRVTMAQIIAIANQKGGVGKTTTAVNLAASLAVLKKRVLLVDIDSQGNATMGSGIQKNDLLYSITDVLLGEVPIETAIQKAEVGYKVLGSNRELSGVELAIAEQEGREFILKNALNEIRDSFDYIIVDCAPSLSLITVNALAAVDGVIIPMQCEYYALEGLADLTQTIDRIQKALNPDLEIIGVLRTMYDARNALTRDVSAELEQYFGKKLYDTVIPRNVRLAEAPAHGLPVIYFEKSSKGAVAYLNLAAEMLKKSKVKKGSKV

SEQ ID NO: 7800 - protein, 163 aa, Acinetobacter baumannii
THIFQLRVAVMAEQNVITSMLDDLSNEQPIHTALCIGQKIDQNNAIQWHYFTVTELLSLPFTQRYDLGFVLFDTDEMQDISDVQKSQLLVKLRDLLAKRIVVVSKRSDEQLLRSLGFTQLIDKTSHDSDFALWQFNILTYKHVPDWFNSKFWANPENWNKFRW

SEQ ID NO: 7801 - protein, 150 aa, Acinetobacter baumannii
GTFMRNVITIQKEFNAPLGDVFNLLSKHAAYNTAFAPLQVVRVKDSADPERPDGVGSVRRMGFGVIKPLKEEITHLEENKRIEYKLIDNPLVKHHLGRIEFSEITPYITLVTYRIELTAKAPVVSKLILAQLKLAITLGFSRLAKAFASS

SEQ ID NO: 7802 - protein, 199 aa, Acinetobacter baumannii
ELLMTNLSNIVEVLAKQALGGNQQASGQGGLGGMLGSVLGQMGGNTSSGAQGGLGGVLGSVLGQVTGNNNTPQTGGGVQSLLIAVVPLILGWVQQQGGLQAALEKLKGAGLGSQVQSWVDPNQSNSEVPTQQLQSLFNPADIEQVAQQAQAPKEQVYGAIASVLPQVIDSLTPQGESTDHQEANQDIQNVMNLVSGFLK

SEQ ID NO: 7803 - protein, 129 aa, Acinetobacter baumannii
IKLISGVPMRYILIALLIIVFGYSLALVLQNPTELPVDLLFTQVPAMRLGLLLLLTLALGIVVGLLLGVQVFRVFQKSWEIKRLRKDIDHLRKEQIQSAQLAAAEAAANVRHEKTVVDIYPQDKNSTPL

SEQ ID NO: 7804 - protein, 610 aa, Acinetobacter baumannii
IKIIMTENLKQKLKHCSVGLFFAGMALTGSISIFAKSPADPNKVLRYVFPTAETGFDPAYVHDLYSAHVLTSIFETLYTYDYLARPAKLIPHVATAMPEVSADGLTYTIHIKKGIYFTADPAFKGKPRELTAYDYAYSFKRLLDPNLRSPNSWLLEDKIEGMNALVKAANKSGKFNYDQNVSGLQTPDKYTLVIRLVKPDYNFPLLLAHDPTGAVAREVIEKYKDKAGFVMGHPVGTGPYMLSKWIPASRIVLKANPEYRGFTWNFNASSPGDEAIVKRLKGKQMPQIGTIDIQVMEENQSRWLAFQRGEVDIIQLEGQLVSKAIKDGKLRPELAKEGVQLSRIVDPEISYIYWNLKDPVVGGMSKEKIALRRAIAMSRSIDQEIKLVRNSDAERLHFPVPPGVVGYDPQYRSSTPYSVKAANLLLDRYHYKKDASGWRTQPNGKPLVVEYKARNDSIGQQSAELWKKNFDSLHIRMVYKPMLFSDLLRSQKQCEGMFGSSAWIADYPDGDNFMQNFYGPNTHMTNWSCGSIPEFDELYRQSQQVKPGPERDALYRKMTRLLEVYMPVQMSYARYRNMLAQPRIIGYKKHPILHAEWMYFDIDTNTKSNH

SEQ ID NO: 7805 - protein, 278 aa, Acinetobacter baumannii
GAVMSLKHPLIRYHGGKFRMAEWIIRHFPTHETYVEPFGGGASVLLQKAPSRVEVYNDLDSDVVNFFEVLRDQQLAEQLAIQIEHTPYSRTEFLNARADATDKVERARRLVVRAQMGFGSAGATKGNTGFRLDTARGGSDIVTIWQRQPELVLQAAARLKKVLIENRDAIKVIQDHDRAETLFFVDPPYVMDTRSIGCNAYRYEMSNDDHENLISVLKNVKGKVILCGFEHPIYEALNWKKITKTVAASGQSGSVPREEVLWINPQAEKQNDLFSEVV

SEQ ID NO: 7806 - protein, 150 aa, Acinetobacter baumannii
MRPIEIIKVVNSFLSFTCSAFIIGFFFYSFVGTESYYKYKDIVDFYNLFVFLINLILLIIVFKYGNLLSERTFDFLENEKIEGLKSGNYIGLLLLSVFNILLFNPIFSFSEYFDKGGDNLNVAYLAMSCSLFLGAVLLYTSRQQIKKLHE

SEQ ID NO: 7807 - protein, 390 aa, Acinetobacter baumannii
VITMTEALTVLGGITAEQFLTEYWQKKPLLVRNAMPEIVGMLEPNDVKELALEDHVTARLIRQKDKNPNEWHVKSSPLTKGDFQKLPKLWTLLVQAVDHYSFDIAELWKKFPFIPQWRRDDIMVSYAPKGGSVGKHFDFYDVFLVQGYGHRRWQLGQMCDASTEFVPNQPLKLLPEIDVHFDEVLAPGDLLYVPPGLSHYGVAEDDCLTFSFGFRMPNISGMIDRISDQFATDELLQNPVVDITRKNPPQIGEINTEELAYLRDLVLAQLKNSTVLDAALMSYMSEPKYPDNIPEPDEIEVEDLNAILSDGYELLLEPASRLLYTEQNGVLKFWGNGDELPIVESFATQLKSIADGKSIPFNSELNNTDILENIVQLLNNSILMLLPPAE

SEQ ID NO: 7808 - protein, 84 aa, Acinetobacter baumannii
FVTIINVGVFMIHLTENAATHISNYLKNRGKGEGIRVGVKTSGCSGLAYVLEFVDDIDEHDQIFEQFGVKVFVDPKSLVYLDGL

SEQ ID NO: 7809 - protein, 166 aa, Acinetobacter baumannii
GVTMSQELHFAVSQFLYKKAELCDAYDWDAYLELYDEDSEYHIPQWIDDHNYVQDPNQGLSYIYYADRTGLEDRVFRIRTGKAASATPLPRTLHSINNIRVKTLDDGLIEAKVAWQTLYNRQGLEGCFYGHATYLLRQTADSFRIRRQHSILLNDKIDSVLDFYHV

SEQ ID NO: 7810 - protein, 286 aa, Acinetobacter baumannii
GLYMSADTQHFTGTDQYIATDSLKLAVKAARALQKPLLVKGEPGTGKTLLAEQVAESLGLKLITWHIKSTTKAQQGLYEYDAVSRLRDSQLGDDRVYDIKNYIKPGKLWEAFTSEERCVLLIDEIDKADIEFPNDLLHELDKMSFYVYETGETITATQRPIVIITSNNEKELPDAFLRRCFFHYIEFPDEATMREIISVHFPNISATLVNEALQVFFKLREIPNLKKPPSTSELIDWLSLLMADDMPEDVLRNRDTSKAIPPLYGALIKNEQDVQLLERLAFMSRR

SEQ ID NO: 7811 - protein, 566 aa, Acinetobacter baumannii
AANMTEDDIRALKKRFDAVWQNRVNDMDDHCAELALHVLPVAIKTIKNQEKHDRSAWSKIVDNTGKDSLKTLAAGMVSGTCSPSRKWFTLQAADEALQKDIEVKQWLKAVEDACYVAFAKSNVYRAVHHIYTQEGAFGIGAALAPDHGPNSKAQPMDVIPMTFGEFAITTDEFNKPNGIFRKFKLTTLNMVKQFGLENVSDAIKSAFENKNFEQEFEVHHAVYERVDAKGYGPKNMPYASIYYEPSATNKLLRESGMMSFQVICGRWTVSSSDVYGEGPASDCIGDLRALQKGHQQIAVGVDYQVRPPLLLPDYLKGHERETLPNGIAFYQASPTSQVAQVQAMLNVQFDLNGVMAQIAQCQERVKRAFHTDLFLMLDAFDKGKMTATEVYERKSEKMLMLGPVVERQIDELLRPLVEICVQRVLSRNKYLQQIAPEAIQNADVEINFVSILALAQKASGSAVLERALAMVGQVAQIDPQVLDKFDTDKFIDEYMDINGVSPNVFRPKRIIDQIRSDRAAQQQIAQQQALEAQQAQTQNTNANTVKTVSDTDAETVSDLFLQGGAA

SEQ ID NO: 7812 - protein, 233 aa, Acinetobacter baumannii
GCSIMKAMILAAGLGNRMRPLTLYTPKPLLEVGGKPLIVWHIEKLKKIGVTEIVINSAWLADKLISSLGDGSQFGVDIRWTREEEGLETAGGIINALPLLGTDPFILVNGDVWTTMDFEALRHIKLNDDLAHLVLVDNPKQHPEGDFTLLNGRAFAFDQDVKGENLTFSGVSVIHPKLFDGLEAGKRPLAPLLKQAMHNQKISGEKLKGAWVDVGTPERLMELDLQIREGFYD

SEQ ID NO: 7813 - protein, 296 aa, Acinetobacter baumannii
SMSIKKRGLAKGRGLDALLGSIQKEKLQLEAQALDHGQLKQIDVKLLKRGEYQPRRFIHEHDLQELASSIEKHGVMQPIVIRPVDDEAHPYEIIAGERRWRAAQIAGLTEIPAIVRDLNDQVAIALALIENIQRQDLNPIDQALALQRFHDEFGLSHQEIADTVGKARTTVSNLLRLLSLADDIKEFMQQGQLDMGHARAILTLKGKEQLEVAKIVIEKGLSVRQTEQLVRDWNEPKQEKEKAPVAPDIEQLTQKLSERFGANVKIDHNQKGKGKLVIHYHSLDELDGILNICLPD

SEQ ID NO: 7814 - protein, 275 aa, Acinetobacter baumannii
NTSMKTEYLRRINLRKAIDTIRLRDKLKSDAAFCDQFGLTPSHISQMIRGKGSFGEKVARDLESQIGLAEYYLDQNHSFPMDDDFLEKVFGKEYKEIKLNETSNQSDSNNSIELMIYEDGDPVPDGYTAIDYYDDVFVSAGNGYLNLMQPSAKKFFVPTYLMRECNVQPSTAKVVKVRGDSMFPVLQDGQPISVDMSAKRIIDGEIYAFQVGDETKIKYLSVWNDEGKGGFKATSANQDKNRYPDEYYSPARIASEGVEIIGQYWMKLDTKKIKR

SEQ ID NO: 7815 - protein, 413 aa, Acinetobacter baumannii
RALIMKLQGSNILGQEQIDLLTTRGLNFVWFPKQLETIYRFQYQNGAAYEFRYRAPIILILYLFLSFGIYQVLPTEQVLSWLSYYSWVGIIVLIAWILSFIKKLNQWFDYYVGIGSSAAVAITFILINVLENGQDNVLFHAAMMYAIVIIYGAVGMRFYTAIIAGWVGGLIGILVSTYLNGDIDWTFLNRTYTFSSFLGMTLAYATDRQHRENYLQNCMIELNRIELMQQAQQLSLLSQQDALTGLANRRYLDETLDNEWRRALRHETPLTIMMVDIDFFKPYNDSLGHLKGDQCLKDIATAISSIAARSGDLVARYGGEEFLLLFPMTNAQQAKIQAERLMNAIKKIAIVHPCSSVSPYVTISVGVATTIPRLNDSISAFVSRADHALYQAKTNGRNQYQIALNEEQIVDLT

SEQ ID NO: 7816 - protein, 97 aa, Acinetobacter baumannii
KLLIIRDINMTNNFNAEQARKNAKDVKIDQALLLEKILSGTEEISKEGKRRAVFQFPIDALHPEHITQVEEELKIRCFNVSTNIEQSGTTVNIEVSF

SEQ ID NO: 7817 - protein, 434 aa, Acinetobacter baumannii
DTIIMTNMINKAQGLGLSLITKLAGSDVLDQLKLRKFLERSLYQGSKAGFRALSQTQKAFKPKQIPQQRLPQQKKNLFDLSLTEEQQMTSEAMSQFAQEVLLGLAHDADQTAQFPESLWQYVEDLGLNYYALPEALGGVAAEQNIVSNLLIAEKLAEGDFSLTAGLLSTFSVINAITRWGSTEVQSMYLPCFAEDSDITATFAVQEATPAFNPYVLKTKASLENDQYFIEGEKTLVILGDLADVFLVSADFNGKPDVFVVQAGDTISIKSTPAMGLKAAETATLKFSHTPALRLGATDFDYTAFLDLGNLMWCAMAVGTCEAVKAYCIKYANERTAFGEPISHRQSVAFMIADMAIEIDAMRMLILNAASLAEAGKPFHREAYLARLLCAEKSMKIGTDGVQILGGHGFTKEHPVERWYRDLRATAILHSGLHA

SEQ ID NO: 7818 - protein, 331 aa, Acinetobacter baumannii
FLIIKIIKEKDMQLTEEQLLTAYKRMRDIREFEDRLHEENTNGDIPGFIHLYSGEEAVAVGICENLTDKDYITSTHRGHGHCIAKGCDIHAMMLEIFGKDDGLCRGKGGSMHIADLDKGMLGANGIVGGGPPLAIGAALTAKTLKTGGVGLSFTGDGGSNQGLTFEAMNMAVVLKLPVIFVFENNGFGEGTGHDYAVGSKDIAGRAAGFGLPAVKVDGTDFFAVYEAAQTAIERARRGEGPSVIETITNRFYGHFEGDPGLIRSKEEVEFIKENKDPLKIFREKVKGKIDEAKLDEIDAASKANVDDAVAKARAAAYPKPEQLLTDVYVSY

SEQ ID NO: 7819 - protein, 183 aa, Acinetobacter baumannii
TASLFNCKRGMMMREQFESLPEIKEILGSLHPTIIWFGADSKYHTSFSGFDNAVIRLNGAWDIYKRCLGRTMTHVQNEITKHLKDQSSKVHNTSCTYQFELAFHRLQDTPELRKIYWSALGQLQFDSNDQVIPPELEECPCCKQPIIRKIGTETAGYETYDIGIDESGNRYIRHPHCEWEPEE

SEQ ID NO: 7820 - protein, 117 aa, Acinetobacter baumannii
PIPILGLAFFFIFYVSVNMSRTLNLPMLYRIKVFYRFLIVFGMGYACMAYLSLGLTEIFHLNLGKPEAIYLAAFISILFYVFFVIVGFCIQSLLRLTILSIALFALFFIVTRTVGYA

SEQ ID NO: 7821 - protein, 95 aa, Acinetobacter baumannii
EDVLFMNKSELIDAIAEKGGVSKTDAGKALDATIASITEALKKGDTVTLVGFGTFSVKERAARTGRNPKTGEELQIKATKVPSFKAGKGLKDSVA

SEQ ID NO: 7822 - protein, 140 aa, Acinetobacter baumannii
LTQMQLNQRAYVVREDQAGILNQLLSSLDAIPEEIIALTAYGVGAIIALWCWWRLMRRLPTTLGAISWLVVFAILVTPTVSEGPNASVAPAIFGLLFGVLTKDSPLIWSNLSLILFVIGLGLVIGYCWSKYITNKSMRSI

SEQ ID NO: 7823 - protein, 67 aa, Acinetobacter baumannii
VFKMTQVMIKAYDFANTKEVDLLADIDKGGNILKVYDYNGNELSINMDGTVTFNRKRWELPVKVDLK

SEQ ID NO: 7824 - protein, 210 aa, Acinetobacter baumannii
GGKIMLIDCRFELQMGQFHSEPNFQSDASVIGLFGASGSGKTSILHAIAGLNTPHSGLIKIQGQTWFDSDQKINLSTQKRHVGLVFQDAQLFPHKTVKQNLLFGLKHLSQQERHFEADYIIELLKLEHLLQRMPIKLSGGEKQRVALGRALLYSPKLLLLDEPLSALDANHKAEIIPFFQKVKEEIKIPMIYVSHDIQEIKQLTETMWVL

SEQ ID NO: 7825 - protein, 354 aa, Acinetobacter baumannii
EIKMNWWLESVQQPNLDAKQQAEQHQLQLTKPTGALGDLEQIAITLASLQSNAHPQVSHPWITIFAGDHGVVEENISAYPQAVTRQMLQNFTTGGAAISVIAKYHQAHLQVIDCGTAGEAYEYAGVERHCIRAGTANFAKQAAMNADECRAALELGKKSVDTAKANGADIYIAGEMGIGNTCSASALACLLLNDTAEQLTGVGTGIGADQLRHKIEVIEKAIELHHKHVIGDVFKTLCAVGGLEIAAIVGAYIRCAQVGLPVIVDGFISSVAALCAVRMNPQVRDWMLFGHQSAEYGHRRILQELNAEPILNMNLRLGEGSGAGTALALVKMACALHNQMATFAQAAVSGNKIG

SEQ ID NO: 7826 - protein, 677 aa, Acinetobacter baumannii
MKKIGDTMKNNTLKMTTLCMLTIGISQFASAEVTRATLPLLKAEQLPAWCDSNLKKNQQEISSFEKTPVKNDAAAAPILAKWDKIFAHLEDFSGPIGLYSNVDPDAKLRKAAEDCEIKINQFHTDIFQNSKLYNVIKNTKATDPIDQKYRQDILDQFEDTGVQLEPTKRARMKAILDELTKLEQEYNRNIRDNPEKLEFTPEEMKGLPESYISGLKKNTKGNYLLGFEYPEYRPFMELADNDDARKKYQIAFTRRGTEQNLKLLKQAIDLRYELAQLFGKASYADWALKDRMAKTPEAVNKFLAEVQKTVAPLERKEVEELRAFKAQTLKTPLDKTEITRWSEAYWSEKLRKSKYQIDQEKLRDYFPTLAAQKWLFAISSDLYGIDFKPVKVKAWQDEVEYYDVVDKKTGKLLGGLYMDKFPREGKYGHAAVWGVYGGSTLTNRLPISVLVTNFNRKGLNSDELETFVHEFGHALHGILSNTRYTSQSGTSVERDFVEAPSQMYEEWARRKETLSKVADYCDPACPRVDDELIARLKAVHNYGRGLRYARQTLYAQYDMALHTADALKVKPLETWQKMEAATALGYVPTTEFPGQFGHLMGGYQAGYYGYMWSEVLALDMLSAYGDNLNNPQVGQRYRQTILSQGSQKPAAELVKDFLGRDPDNKAFFNEITGQRVK

SEQ ID NO: 7827 - protein, 256 aa, Acinetobacter baumannii
EEKMKHIVIPARFSSSRLPGKPLLLIHDRPMILRVVDQAKKVEGFDDLCVATDDERIAEICRAEGVDVVLTSADHPSGTDRLSEVARIKGWDTDDIIVNVQGDEPLLPAQLVQQVAKLLVDKPNCSMSTLCEPIHALDEFQRDSIVKVVMSKQNEALYFSRATIPYDRDGAKRDEPTLHTQAFRHLGLYAYRVSLLQEYVTWEMGKLEKLESLEQLRVLENGHRIAIAVAEANLPPGVDTQADLDRLNNMPVESFE

SEQ ID NO: 7828 - protein, 72 aa, Acinetobacter baumannii
TLKMRKLKNYFMRLRILFLQTPESTLVVLNSIFILNKNLLNCYKNKGQLHTVLYAFLNELFNDFNTSRSRNN

SEQ ID NO: 7829 - protein, 218 aa, Acinetobacter baumannii
KRKIPMSIPKIASYSMPQAHEFTPNKTNWSLHTSRAVLLVHDMQQYFLDFYDLTQEPIPELIQNTKALIDAARQSNIPVVYTAQPGNQSPEYRQLLTDFWGPGLKDEPSITQIFPKISPQKNDTVLTKWRYSVFKFSPLEQLMRDSGRDQLIICGVYAHIGCLMSAAEAFMLNIQPFLCGDALADFSREEHDMALKYASTRCAQVMTTQQVIQAWIQE

SEQ ID NO: 7830 - protein, 337 aa, Acinetobacter baumannii
ESEMKRINVAICGFGRIGQQIAELLLNRSTYYKQKYQIDARLVGVCNSSSGLINQDGLQASKWLDKTQYQAGLTEQKFLEQVQADVIIETGPSDYVTGGKGLFYLNYALTHNMNVIAVSKGALVVEGKKLINLAHQHNKKLFFSGATAAALPTVDLFEYNLAGCQILEIEGVFTGTTNFILNDMLQHECAFAESLEKAQTKGIAEPDSSFDVDGWDTAAKITILANTVLGADVKIQDIPRQGISHVTADHIRDWKKENVIPRLVGFIHIKNQQIQTGVELRLVPANHPFAHLQGSNKCIRVLTQEMGEFVVTGGASAPLATAAAALKDFELMLKTGY

SEQ ID NO: 7831 - protein, 296 aa, Acinetobacter baumannii
RKEMTLKQLKAFLALARTLNYANASLELHLSQSALSLTIKSLEEELGGKLFNRNTRRVELTQEGKSLIPYAKKLLANWDEMENDVKQRFKLNRGTLSIASMPFVTHAILPEVIHQFLAVHPNLNFSIHDIPNETIIEKVQDGIFELGICFEPDLTEGLEFKPLFEEDFLALLPKSHPLAQSSSITWHELCSNPFVTLQKPSIVRYLVEQNCLRNNITLDLKVECHQISSLSSFVAYGIGVSAIPRHFAKHIDKEHNVLIDLKDEAIHKTVGIVYKKNFEISNISAQFIEALVQYKF

SEQ ID NO: 7832 - protein, 335 aa, Acinetobacter baumannii
GIRMSFYYQALDDIDEYNQEFLAPLNHADEKIRFVALMNIGDEENPDLLPWLHAALQHDSSALVREEAAKKLESWEDSTSLQVLAQALFDADLNVRQAASQSLSEVKNPASTQILAPYLKHTDTFALGAILRALKPLRPQQLFEEISALVHHEDAFVRREAVSALSWLQQDQAITILAKIAETDTDDEVRRIATGGLAYSQSISAEVIQALQHSLTSESWQLRVEAALTIGKLRIVQLEAPLIHAVSDLYWQVRIAAVRSLGLLKSHLAVAHLTDNFKHEISNLRKEVALALGEIGTAEAQKLLEQHQNDPDPEVRKAIRIGLNQIGEVKYANQT

SEQ ID NO: 7833 - protein, 357 aa, Acinetobacter baumannii
QGRISRTTWEDIMALISMRQLLDHAAEHNYGVPAFNVNNLEQMRAIMLAADATNSPVIVQASAGARKYAGAPFLRHLILAAIEEWPHIPVVMHQDHGTSPDVCQRSIQLGFSSVMMDGSLGADGKTPTTYDYNVDVTRQVVAMAHACGVSVEGEIGCLGSLETGMAGEEDGVGAEGVLDHSQLLTSVEEAKQFVADTNVDALAIAVGTSHGAYKFTRPPTGDILAIDRIKEIHAALPNTHLVMHGSSSVPQEWLKVINEFGGNIGETYGVPVEQLVEAIKHGVRKINIDTDLRLASTGAIRRFMAENPAEFDPRKYFAKTVDSMKQICIDRYEAFGTAGNADKIRPISLEKMVDRYK

SEQ ID NO: 7834 - protein, 340 aa, Acinetobacter baumannii
ASRISTLIHHNHDQSGRDFFIGNKKMKSTLIKHGFLAGTLLGLPLVTHAYDLPTVNLGMTSFLDGGLPAGPGWYAQTYFQNYDSNKLVDANGQKLGLPKTDLNYQVLVEQISYLSNVRVKDKASLGINFLVPFVSKMDMDDGLNNAAIKAQSGFGDIMIGPFIQFDPVMGAQGPKFVHRFEFQMNLPTGEYDQQKDINPSNNAVSFDPYWAATYWFNPKWTASTRIHYLYNFKNDDPSYAFAGANDMQAGQAIHANFATDYAITEQFRLGLNGYWLKQVTDTEVDGEKVKGRREQVWAIGPGAMYSFSKNDHLVANAYFEQDAENRPEGTRLQVRYVHHF

SEQ ID NO: 7835 - protein, 694 aa, Acinetobacter baumannii
ESRMTSLPTLASSNQHNLETYINRELSLLEFHKRVLAQAKDIEHPLLERLNFLIIFSRNLDEFFEIRVASLIQKISLMSQATGPEGLPLVEVLKQISKNAHEAVEEQYKILNYTLLPQLQGYGVHFIQHGDILEKHKEWIKEYFFKEVQPVVTPISLDPAHPFPRLVNKSLNFIVTLEGKDAFGRQIDLAIVPAPRSLPRLVKIPEHISGGAEHYILLSAIIHQHISDLFPGMKATGCHQFRVTRNADLTVSEDVEDLAAALKGELSSRRFGQAVRLEVAKKCPEEIANYLLEQFDLDAEHLYYVDGPVNLARFISNFDLPELRYKPYQQVLPQLLYTKKPIFDVLKAGDVLLHHPFDSFAPVIKFLREAAQDPNVLAIKQTLYRSGANSEIVQLLAEAARNGKEVTAVIELRARFDEESNIEVANVLQEAGAVVVYGIVGYKTHAKMILVVRREQEKIKRYVHLGTGNYHAVNAKIYTDFGLLTNDAEICEDVHKIFQELTGMGKMAKLKKLFHAPFTLHSQLLELIEQEIKNSLAGKKAHIIIKVNALTEPQLISALYKTSQAGVKIDLIIRSICCLRPQVAGLSENIRVRSIVGRYLEHTRVYYFYNDGDTKVYCASADWMERNLFSRIETCFPIENKKLKKQVIEDGLNNYLKDNRQAWELQADGTWVQCHPKPEEELYIAQQHLMNLAG

SEQ ID NO: 7836 - protein, 626 aa, Acinetobacter baumannii
NIGILMESFRTVIKGWLGKVLLVLFLTPLALVGIEGYFNRGNKADVAKTVNGQDISKKDLETLTQRYKEQYLAAVKGDESLLNLPVIQAKALDILVSRNLLIQQAEKLGISLSDAQIEQMLAQQPSLQENGQFSQKLYENYLRSIGMTSEGLIASLRQDHALKMLTSTFADYSLVSKVDLMQIANLQTEQRTLHLASIKLDPYKAGLTVSNQEATDYYNKHQNEFKQPASVDVDYVVLSPSLMAKPAPATDAELKQAYAKFVETQQKDAKRIVKHILITTDARDDAAAQKLAKDVYAKIQGGLSFAQAAAQFSEDPTSKTKGGLVEAYAPGVFSDAFDKTVLSLKNGQISQPVKTQYGYHIIEAETQANQIPSFEAEKPRLIAEVEKNKVASVYSDTVNSLNETIVGNDSLDAVVQQVKGTKIESLNGVTLATQNPYLSDPNVKIKLFNDDVKNGDRNASSNIQLANGDTVWVKVRDYHAAGVKPLAQAMNEVKAKVIDEKARKAAQAKIATMLTEFKTQPAEQVVAKNKVAFESAGVFTRSQGLKRAIERAAFSVPAPKPGMWSVTTANLPNELVVVAVSNVNSAAVNAMPADQLQQLKQLYRQSRGQQILEDYSEYLKSHAKIK

SEQ ID NO: 7837 - protein, 325 aa, Acinetobacter baumannii
ITTLNYQNKACFMECMRIQPVTSHPGENALFIVLGLAQGDSVVEKVKDFVGKFSALTRSLSNRYPETKFNAILGFSSNAWDILFPQQAKPQELETFQEIKGPKYTAVSTPGDLFFHIRADRQALCYELGSIINEQLGKVTYPIDEVHGFRYFDGRAIIGFVDGTENPEPVIAAQWALVGNEDPDFIGGSYAFIQKYTHDMEKWRALSDDEQEKVIGRKKFNDIELDDEEKPLTAHNVVSKAHDAEGNELKIMRANMPFSNPSKNEYGTFFIGYSRKFSTTRQMLENMFLGNEQGNLDRLLDFSTAQTGTLFFVPTVDFLDGLGDE

SEQ ID NO: 7838 - protein, 381 aa, Acinetobacter baumannii
TRLMQLQRQMLMMPLLKPVLRHIRNQNNSLLTSMSLTKGIVKMPNKSFRNAIKEAIESEMRRDPTVFVVGEDVRGGHGGKNTEENQLEGFGGVLGVTKGLWTEFGSERVIDTPITESAIIGMAAGAAATGLRPVADLMFMDFYGVCHDMLYNQAAKFRYMFGGKAKAPMVVRGMIGAGFSAAAQHSQSPYNVFAAVPGLKVVVPSSPYDVKGLLIQAIRDDDPVVFCEHKMLYDIKGEVPDDAYTIPFGVANYTREGTDVTIIALGLMVHRANEVADKLAKDGISVEVVDPRTISPLDEEGILESVASTGRVVIVDESAARCGFGHDVAALIAQKGFHYLKAPVELVTPPHTPVPFSPVLEKEWIPSVERIEQAVRKTLEA

SEQ ID NO: 7839 - protein, 197 aa, Acinetobacter baumannii
FFMIIEIETHPLQPFLPENARLLMLGSFPPPRNKWKMDFYYPNFQNDMWRIFGLIFFQDKTYFLSENQKSFNEEAIRSFLIETGIAIFDTAYQIKRLKGNASDKFLEIVTPTDLAVLLKQIPQCHTIMTTGDKATDTLISVLPENTEKPLIGTSTSTYFADRDINLYRLPSSSRAYPLALEKKAEAYQKFFKEIGFL

SEQ ID NO: 7840 - protein, 235 aa, Acinetobacter baumannii
FYVMEESLLSIIVALDAKSQYDALKIVEQLDPTLCRVKVGKELFTHEGPSVVKKLQEENFEVFLDLKFHDIPNTTAQAVCAAADLGVWMVNVHASGGRKMMETCVERLKAGNYQTQLIAVTVLTSMGREDLKDIGLDIEPVEQVKRLAKLTKESGLDGVVCSAQEAKILRELIGHDFSLVTPGIRPEGSNADDQKRIVTPKQAMLDGSTHLVIGRPITKAENPTEMLKSILTSIA

SEQ ID NO: 7841 - protein, 63 aa, Acinetobacter baumannii
QNALELHLPQFHKQRNLKEMKFGGIQLLNRALYYFANNFAQLNIEQLRVFARLQMDLNKAHAM

SEQ ID NO: 7842 - protein, 340 aa, Acinetobacter baumannii
MPTIVQTNPTLADVAHNIGKNSKVGAIIEVLNKRQDLLDDAVVLEANSGTHNKTSVRSGLPKGTWRKLNYGVQPEKTSRVQVSDSTGQLTSYSEVDKTLYDLQGENKKQWRSEEDAGFLEGMSQEVMENIIYGDVAGDVSTFNGLATRYNHLIDPETGVAPANAVNILDAGGTGTDNTSIYIVQWGREKTHLFYPQGTQAGLDIQDKGQQTVLDAQGGRYEAMRTYFQWDVGLSVRDWRSVVRIANIDVSDLSKDASTGANLIDLLDEALSLLPLAGSARTAIYMNRTVKQALKGQVNHFKNVRLTLEDFRKDGSRKIQAWDGEPIRICEVILNTEARVV

SEQ ID NO: 7843 - protein, 259 aa, Acinetobacter baumannii
YLTMNTSFKIQAEKCATLPILQQRLKLNVQILPESSTTLDCLLNDDVCRQVLQDFATRIHAKNLTCATSLFVKYWCTSWILPFLYCHAAVLPFVKWASSALVIDLPEQWYWDRTLQLNQASFHSFQIIHLQEFNDLIEQLNLLFKQLAKIGRVPYILLWENLTVRVVQFYHSFTKQNLNLDIQSRLEQQKQFFKSKTAESFYLTENPFMRLWNGWHPEFNTFMRQKCCFYFQLEEAEQTLCRNCPLRLKEIGKFKDESN

SEQ ID NO: 7844 - protein, 419 aa, Acinetobacter baumannii
LAQIQLFYRVQVFDMKRPIYLDYAATTPVDPQVAERMMECLTFDGTFGNAASRSHAYGWQAEEKVEYAREQVANLIKADPREIVWTSGATESDNLALKGVAQFYASKGKHIITSKIEHKAVLDPCRELEEQGFEITYLEPEPQTGLITPEMVKAALRPDTILVSLMMVNNEIGTVTDVAAIGELTRANKTFFHVDAAQAAGKVDIDLSTMKIDLMSFSAHKIYGPKGIGALYVRRSPRVRLKAQIHGGGHERGMRSGTLATHQIVGMGEAFELAGKTMHAEQERIRKLRDKLWNGLQDLEQVFLNGHPTQNVANYLNVSFNFVEGESLMMSLKDAAVSSGSACTSATLEPSYVLRALGLSDELAHSSIRFSFGKYTTEEDIDHVLTITKAAVEKLRELSPLWDMYKEGIDLSTVEWAEH

SEQ ID NO: 7845 - protein, 121 aa, Acinetobacter baumannii
CDEMFKKLTQLFQGSKETPEQIYLQENQLSFDSERGPVIKNVVINEKWSEHLEYFSNRKLQNFDNLPKLFQITPQINEKIDLEIATQRYVERLGNTQEKLLELKAIIQVLNQYYVMFLRDK

SEQ ID NO: 7846 - protein, 228 aa, Acinetobacter baumannii
KIYFYDEIKLGLNMSRSRRSDGDLTKTKIIEAAGPLIAQYGFAKTANKTIAKVANVDLAAINYHFDGRDGLYQAVLMEAHAHYLDEQYLLELVESIYSPEEKLSLLLETLLHKLTEKDVWHGKVFIRELFSPSEHLLSFIELTGMRKFFLIRKLISQVANLDENDPAVLPCILSVMTPCMMLIIAGPNAQAPEPLKNIAQMPLHDLVEHFKKFSLAGLKAISQSNLKN

SEQ ID NO: 7847 - protein, 396 aa, Acinetobacter baumannii
PMFVRLFYTLRKYGVPVTTRELIDLNCAVSEGLVFANQEDFYQLAKTILVKDELFFDKFDRAMKDYFDGIETFDIDELLKQVHKLPKDWFDLELLEKHLTPEQRAELQKAGSLEELMKMLEERLREQHKKHQGGNRMVGTGGTSPFGAFGDHPEGVRIGGPGRKRSAVKVWEQRKYQNLDDDQVLGTRQMQIALRRLRKFARQGAAEELDVDGTIRETAKQGILDVQMVPERRNRIKVLMLFDVGGSMDAHIAQCEKLFSAAKTEFKTLEYFYFHNCLYDYVWKDNYRRTATRMNTWDLFHTYGRDYRVIVVGDASMAPYELKSVGGSVEYMNDETGEVWLRRLRQHFDKIAWLNPETEGYWHYTQTIGWIKEIFENHMYPMTLKGIEDLTRYLSR

SEQ ID NO: 7848 - protein, 219 aa, Acinetobacter baumannii
IKTVLLKPSTLMVPTPIQDYPEWHLGRQNYALWYLEINDQKLVHYLDQLRAHFSEFLVEPNHRQYHVTLFICGFLTHENKVHGDDFSFTEFEQHKKVLKQENFAPFQLKIGSVDSFSSALFVEVQDTENILSHIRQKLGTVSNEIAALDYCPHITLGLYKKDYSSNLILQKISQLPVQYTQAEFDLKVEHLIFGYYQAQTLQGQLYPYEHLFLGDSCCN

SEQ ID NO: 7849 - protein, 297 aa, Acinetobacter baumannii
LKDVSLNFMELQGICHKMHAGLKDASVTDQQTTKANVEYKFVLDRSEIDLPFNLGQELEIEWTGNIYCTSCGAKTPKSYSQGHCFKCFKTKAECDLCIMKPETCHYHLGTCREDDFAHSVCFQPHIVYLANSSALKVGITRVSHMPGRWLDQGATQALPILKVGSRRLSGQLETMFGSLIADKTDWRKLLKGEAEPLNLIEQRDQLIEEFAPKIQTIREEFSQNLEFNETVELLENELPREFVYPVEQYPEKIKSLNLDKTPKIRGVLQGIKGQYLIFDIGVINIRKYTGYELIVRA

SEQ ID NO: 7850 - protein, 220 aa, Acinetobacter baumannii
TSCLSSSCTELCSIRCINGICSVMKQPKIILASSSQTRKDLMNRLGIEYICISPDIDESPCGETHADDLAKRLAFTKAQVIAQKNPEAIVIGSDQVAWREHAPHNFIGKPLTIENAKAQLAANSGRTVFFSTALSVQCLERSFEHTLVEHYQVKFRNLSAPEIERYVDLDLPLQCAGSFKCESLGISLFEKMIGQDQTTLMGLPMIQLCQILRQLNLQIP

SEQ ID NO: 7851 - protein, 124 aa, Acinetobacter baumannii
MKNVIILTSILLLSGCTINSKLLSPAKSDDDKIIVEAEKYKQQYQKKIFKIWNVPPSSVGMSASVKVFLSDTGEIEQIIFLDKEDQKFKSSIEKAIWRASPFVLPSNPEVRKQVRKFNIKFTAK

SEQ ID NO: 7852 - protein, 61 aa, Acinetobacter baumannii
CIFFIQINLKLFANIKKFSKWKIYFYIKKAKASYSSIIKSIFINILHKLKKEKYIVGTCFA

SEQ ID NO: 7853 - protein, 519 aa, Acinetobacter baumannii
KTLVLPAILFTAYAGFPMLNAKQHAIQKTKIAIIGAGFGGLAMAIRLLQSQQSDFFILEKSNDVGGTWRENRYPGAACDVQSHMYSLSFAPKTDWSKRYAEAPEIFDYIQDITDQYQIKNYCKFNHEVTHVQYDEVRHVWSLDFANQPSLEAQFVVFASGPLHIPQIPHIQGIEKFKGKVFHSSQWEHDYSLKGKSVASIGTGGSAIQYIPEIAKDVKQLYVFQRTAAWVIPRDERKYSNLSKALFKKSNLYRQIHRSRLYWSNESRVVPIVQPQIMKYGQKLAEAFIRFQVKDKDLAKKLTPDFVMGCKRILISNKYFPTFNRKNVELVTEGIQEIKENSIITKDGKERPIDCLIYGTGFVTDPRIYLKHFTCIGRNQIELKQAWKNGAESYYGIMTKNFPNLFQLVGPNTVLGHNSIIFMIESQVNYILQLIDLVEKSGQHAIEIKPEVQDSFNERIQTQLQGTVWQAGGCSSWYQAADGKNFSLWPTYTWKYWLDTRKVNPKDYLLLNKCSQSYAA

SEQ ID NO: 7854 - protein, 201 aa, Acinetobacter baumannii
GKSVFSDRFEQLVQALRILPSVGPKSAQRMALHLLMKNREGAFALAHALHEASSYIHECSVCHSLTEHEICDICASTERDDQLLCVVESPADVMAIEQSGSFRGKYHVLGGHLSPLDGIGPEEIGIPYLIQRLSQGTIEEVILATNATVEGQATAHYLVEATKHLPIHMTRIAQGVPQGGELEYVDSHTLSQAVHNRMRMK

SEQ ID NO: 7855 - protein, 260 aa, Acinetobacter baumannii
ERTVFVDTHCHLTMLDLTPYNGDLDLALAAARAEGVSKFMAISVDLDDYIALAEIAKRHEDVGYTVGVHPCEDVDTMARATTEYLTELAQSEKVWALGETGLDYYHSTDFINEQKDCFARHIQASKNVKKPVVVHTRSAKHDTVDIIRAEQSTHGILHCFTEDWETAKAVLDCGYYISFSGIVSFKNAQDLRDVAKQVPLDRLLIETDSPYLAPVPYRGKTNEPKYVPYVAKALSEVYDKPVEEIARITSQNFENLLKAI

SEQ ID NO: 7856 - protein, 115 aa, Acinetobacter baumannii
RYGVRFMNINMLMQQAQRMQKDMESNIKKAKEELAQTEVHAEAGGGLVKVTMTGRYIVKRIEINPELLQDEPDMIEDLIAAAVNDAVRQAEVVSEEKMQKANSGMGLPPGLAGMF

SEQ ID NO: 7857 - protein, 71 aa, Acinetobacter baumannii
KRMVHMIDEEKPLNFEDDDEPLDFEDEEFIDDKKEDEMYNSITKDGSSVDPADDGTRHIRPEDGDPIEIDE

SEQ ID NO: 7858 - protein, 118 aa, Acinetobacter baumannii
QSWVADMKTHSQPMDLRDYFATAAMQGMVATISNQFELDRLREWAKQNGQTLSQFIASDSYKQADAMIYEREKGTVESIDAIKQKLIEAIGRKHSSLHPNMYMTVDHLIFQLETGLPF

SEQ ID NO: 7859 - protein, 384 aa, Acinetobacter baumannii
SRWVMLSVLPKRKLETQTAPASAGLWRLAMRRLRADKIAMASLIVVLFYLIVLILSLTGVIASDWNKEVAVSYAPPTFIGADKTTEALKSTAAVDEELPENPVDPLKDVIHQLKAEIKQEKSSGSAIDYYGVVDPLADDMKAIDQQLGGHLLDQQSELKSTLIFGADKWGQDVLKKTIKGAETSIIVGLVSALLAVTLGTLLGAISGYFGGWVDDILNWFYNIFTSIPYLLLVLAIAAVLQQKGILSIVLILGLTGWTGVYRLIRAEYMKHTAREYVLAAKAIGVGHFRRMFIHIFPNVSHIALVQMSILVVSFIKSEVILSFLGFGVPVGVVSWGSMLNEAQSELLLGKWWQLVAASVAMAVLVTAFSMFTDALRDALDPKLK

SEQ ID NO: 7860 - protein, 382 aa, Acinetobacter baumannii
GMRVRRPTMSFAFWSRLKALVRKETKQLLRDKSSLGIGLVLPVILILLFGYGLSFDLNQARVGVVVDQSSPQVNQVLAGLNGSRYLTSLEFHNLPEAEQAIRNGKIDAILHLPSDFANQAQQGNAKVQLLLNGRSTTIATALEGYVAGALATAPSIQIDRSPILASASAVKIEQRIWFNESGNSTWFLVPGLMVLILTLIGAFLTGLLIARERERGTLEALFVTPVRPFEIVLAKLIPYVVVGMIDIVICIVAAHFIFEVPMRGSLFSILFASLLYLIVSLLLGLTISGFAQSQFQASQIALLASFMPALMLSGFVFDTRNLPLVVQIISQLLPATHFMVLIKTLFMGGDDWKLWFKECGILLGYIVVLICAVNFSLKKRLR

SEQ ID NO: 7861 - protein, 169 aa, Acinetobacter baumannii
IRSLVRPNKLVLAKLPLLLPLQLPRNDFKENFMGMNVGSNNEDDVMLEVNMTPLIDVMLVLIIMFIITIPAPNNAININLPNGTPPPTNEKPPEIIDVRIDAAGKVFWNNQQVSDRKALETLFQGVVAKKDQDQIKLKPDQMAEYKNVAMVMATAQRLGVTKIGIVSSN

SEQ ID NO: 7862 - protein, 187 aa, Acinetobacter baumannii
LTQLRQVQYPQDIPLLHRWMHEPHVIPQWQLNKSEIELKVYFEKMLADDHQRLMIVGINGQDVGYAEIYEGKRDRLARYYKGEDNDLGWHLLFGEKSAFGQGFLRPTIRLLNFYIFENSPTNRIVGEPDHTVKPYAAVVEDMCYEEQGLIPMPEKTAMLYYCFREKFYDRFFELYQASQQKLQQKAS

SEQ ID NO: 7863 - protein, 361 aa, Acinetobacter baumannii
IRQLILSLLYSKTFQSREIDKRMKRSALGLIYLIQGMRNAGIDVDSRLADIGIKVDSLDPSSTIHDSLEWDIQQIISENVDPEKGLFIGQHYALAGYGPLLMLLVTSHDIQTALEKGIQYQKLTHLFGTLSLQETENHIILNYLPVDLKTEIGLLRAQCEISGTYKFIQDIYTMMGLKMPDMRIDLPFPEPSDPDTFAQYYAYYGDDLHFNSTHAAFSLSKNMLEIKIPSADIITHRIYEAKCIKEIERLNEQDHQIPPIIQYVQDYLELQQGIIPSMAETAFALKMPERTLRHQLQQLNTSYKQIREQIIKNKALKLMEYKEYSIEVIAEALGYSEPAAFNHAFKRWFGQSPRQYGKEFY

SEQ ID NO: 7864 - protein, 132 aa, Acinetobacter baumannii
EKKLIWIKFILYPLGMFVLWQAIFIIMQLSLTSLNMSQVFVGIISLIINCGMQILIDYKIPHLAPKYKFVVSATYVILFTFLLATYSTTVLLEGLKVAPQAIWLGYLFFHVIGVFIYFSNNRDEFCWDNLLK

SEQ ID NO: 7865 - protein, 255 aa, Acinetobacter baumannii
IGKLAMTALNQYGMSLEITPHNGWSQRFWEDLLPVKERVSKHPFFTEMANGGLSLESFRYALLNFYPLVAHFPSYMAGALAKVTAFAEPGVTETRDWLIQNIKVEERHLQWYRDWAKGFGLTVEQLDSVRPPASMNAVNHFLWNMSHRGNLAECLAATNLAIEWATGDWSIQVYKGIHAYTDHPEVTIDKRSLAWLRAHAHYDDLHPYEAMELIKRLCNERPDWQQKAFHAAEEGLRYYELALDDCYRVQLQASA

SEQ ID NO: 7866 - protein, 280 aa, Acinetobacter baumannii
FFEFFNGNRDCYSHFYFFIIQFVFRYRSVRDLDMTPFWIALQFLTVLPIELKTIPTAQQNGRAILFYPLVGLIIGGILFLVTCIFVKLPALLLAAIVLALWIWLTGGLHLDGLADTADAWVGGFGDKLRTLQIMKDPSCGPIGVLSLVIICLLKFALVYVLIEQHQSLFLICIPILGRVVPSILFLTTPYVREKGLGRSLTDHLPKTASWIITGFVLLLPLYWGWQGLIAIIGFLISLVYLRHVFIKRIGGITGDTVGAAIEIGETVLMFTFVVSYFYLV

SEQ ID NO: 7867 - protein, 104 aa, Acinetobacter baumannii
TGEFMSYKHNNLMAMRHRFWDESSDHVLNEKQFLQQTLIEQGIFNNATFDDVKYFFYTLPSIVIVKAHALGFMHDSVKQMVIQHIQANRMHLMQKAELKIQFKM

SEQ ID NO: 7868 - protein, 671 aa, Acinetobacter baumannii
MQYSFNGGVISPDMFGRIDQAKYQTGVAKCKNFYVELFGGLVYRAGFRYVHHYPKSMGKMRLIRFVFSEEQAVVLAIRAGAVNFFADGGMLLDDNDQPLEVALPYAEQHLMQLRYAQSADVITITHPDYPPRKIIRKGATEWTTEIVTVGYGLAQPQNLNGTVKKVNENGYIEREYVYQVTAVNDENESQASAKSPVLKNDLTLSGNENILTWDAVLGATRYNVFKLRSGLASYIGETTELSFTDDYIETNGAITPPLIRNPFEFYPMAVAYHGQRKVYGGGYKSPQWLRMSRTATDDNFGYHIPLQDTDSIQIRFAARDGNGVRHLVPMSDLLILTSGALWKMSADGAVTAASVNVNKQYSTGANDVTPVEVDGAAVFASDQTGHVHEVSLASGYNASFYQTIDLSIMCPHLFDGHKIVDCALLRNPLNIIYFVRDDGVLLSLTYEPQQQVWAWAEHHTDGKFLSLAEIPEDNQSVLYAFVERNGFYTIERMLTRQPLDMQDKCYLDSSIQYKGNPTSTLTGLDWLEGQTVSVFADGGVKPNVKVENGTIKLPRELSNIWVGLGYEAEMQTLPIFQEQRSPVKPKVVNKAFLRVLDSQNILVGANQDIEDRTPIDEFKPRSNERYGSPLKLYSGLVEVPVDSTYERDIQITVKHDKPLPMKLLALEVEMT

SEQ ID NO: 7869 - protein, 452 aa, Acinetobacter baumannii
RVPFVSNVTSFRSELKQLFHLMLPILITQFAQAGFGLIDTIMAGHLSAADLAAIAVGVGLWIPVMLLFSGIMIATTPLVAEAKGARNTEQIPVIVRQSLWVAVILGVLAMLILQLMPFFLHVFGVPESLQPKASLFLHAIGLGMPAVTMYAALRGYSEALGHPRPVTVISLLALLVLIPLNMIFMYGLGPIPALGSAGCGFATSILQWLMLITLAGYIYKASAYRNTSIFSRFDKINLTWVKRILQLGLPIGLAVFFEVSIFSTGALVLSPLGEVFIAAHQVAISVTSVLFMIPLSLAIALTIRVGTYYGEKNWASMYQVQKIGLSTAVFFALLTMSFIALGREQIVSVYTQDINVVPVAMYLLWFAMAYQLMDALQVSAAGCLRGMQDTQAPMWITLMAYWVIAFPIGLYLARYTDWGVAGVWLGLIIGLSIACVLLLSRLYLNTKRLSQT

SEQ ID NO: 7870 - protein, 130 aa, Acinetobacter baumannii
RGGSMYYPLLSIALGSVLGAWLRWFLGLKLNPIYPQIPLGTVTVNLVGGFIIGFAMAYFAHSDLNPNYKLFVITGFCGALTTFSTFSIEIVTLLQSGKWGMAMSAISIHSIGSLIYTCLGLATYYWVAGH

SEQ ID NO: 7871 - protein, 233 aa, Acinetobacter baumannii
STFSIHIFRIKWLLQIDTILKYVSLSVKRCVKTKLAVFMTTGRILNIPNILTLARIALIPVFLVIAYWPPAIGIGEHVGSMTRHIILTAIFVLAAVTDWFDGYLARTLNQTSAFGRFLDPVADKLMVAAALIVLVQWKPTIAMAFAAIVIISREITVSALREWMAELGARTSVAVSTVGKYKTAFQMIAISVFLLNWQPLEVLAYALLYTAVILTLWSMFIYLKAAWPYLKQP

SEQ ID NO: 7872 - protein, 584 aa, Acinetobacter baumannii
TLPFTRYLTQPCYEIRSFLMMLADPSKKYRRMYQRVDLPDRQWPNNEITKAPIWMSTDLRDGNQAIFEPMNMEQKFKMFKMLVKIGFKHIEIGFPSASQIDFDFTRMLIEENHIPDDVYIEVLVQARDHLIERTFEALAGAKRAIVHIYNSNSPTFRQKVLNVDVNGAKQLAVNAAQKVKEYAAQYPETDWIFQYSPECFSATELEVAKEVCDAVTEIWDARPDHKVILNLPATVEVSTPNVYADQIEWMHRNLARRDGVIISVHCHNDRGCGIAASELAIMAGADRVEGCVFGNGERTGNVDVAAIALNMYTQGVAPELDFSNINEVIATVEECTGLPVHPRHPYAGDLVFTAFSGSHQDAIKKGFEYQKNEEIWDMPYLPIDPKDLGRDYDAVIRVNSQSGKGGIAYLLESNYNVVLPRRLQIEFSQVVQQYTDENGTEISAKQIWTLFKDTYVEVKNHHYTVKNYKLSDINGTQIIELEIDVEGETQQLRGEGNGPISAFLNALQLPIDVLNYEERSISSGANAKALTLIELQVKGTGRGSFGAGVHDNTVTSSIEAIIACTNRLIDQGVLSTDQVVAAAV

SEQ ID NO: 7873 - protein, 110 aa, Acinetobacter baumannii
GMHSFVLVVHIILAVLMIALILVQHGKGADAGASFGGGGAATVFGASGSGNFLTRVTAILTALFFVTSLTLAVFAKKQTTEAYSLKTVQTTAPAQTTSPETSPNAPKTGQ

SEQ ID NO: 7874 - protein, 1233 aa, Acinetobacter baumannii
GMNSRVQVSYQPIIDIEFSGLHLIEASAGTGKTYTLSSLMVRIFLEKYLPGQVIATTFTRAAAAELKSRIRARLIETHRYLDAKRSLTEKEILLQAEQETDLLLQHILKHFATRIAYACERLKLVIDQLDELFVGTLDSFSQKLLREFAFESGKIERAQITDDAKTYSRQLIHDVLREWIQSQPQTVIDALYLAGELKSVDSFVKLVEDSLNFSSAHFKLPEKPTIQFEQLAQLKQLATEIDISLLEPYYLLDGEHYKHVNGTIFRNGAFNKLFSECLPQLLQILKQSDSILVFDGSLAAQRELVFKFLGQLADQKVFKKCPAEISDGFYQHPCIQQIQQLFGVLKNYAEQFDQLHIYLKAYLCVEVKKRLPQVLQNKGETTFSQQIRTLSEALKGEQGQRFAVFVQARYPLILVDEFQDTNQDQDDMLASIWRHPERYQKGCMIMVGDRKQAIYGFRGGDMLTFLNAYKDIQAKHGREYKLIHNHRSVADLVEVVDALFQRQIDFGEQVQYDPIRAGTRPHPVLIDQNQPNPHPLRWLMLKDKETEAQQVAWKIRDLLNQSHAGQLYFQKDAQTQILNEDDIAVLSRNHDGLDKVQFELERLGIRVNRPSKRSVFDCTIAQDVGALLTAILHPYDEAKVKRALISRLFAMDLKQLLQLEQTAEGLSQFMTGFDTIRELWSAQGFLVAWQQCLNQFGIWKNLVAVQSKDNERVVVNLRHLTEILSQHSEKYQGAQNLYHWYLKQLQSPLDREWELERRLSSEAGVQLMTIHQSKGLEFKIVFLLGADKPFRENNKTLNFSTQDITVPESAQTLTQRVVAIADKTYLNEIELKQHEERALAEQNRLWYVALTRASHRVYALLQDTDGKSVSGLAFWKNRAEPFQHHCCTDEIILEQPPAARHLNQHINIIEIQAQHFPDQRFYSRGKTSFSYLAQHLRHKVGTDLLASQSHEAVLAEDELDQVISVETPAAQPINWIKSNFPRGTLAGNFLHEIFEHIDFQCSDEWVSEIRRRFKNDYSSLWQDLLIKYQESFPEEQEAEYSLYHAVAEWLQEILSTPLYQGFRLNQLQPEHYLSECPFYLALSDRVLAMKRIQQLFAEYGMEMPELLEARSARYLNGSIDLVYFDGQRYHIADYKSNYLGENLADYSVESIAQSMSLASYWLQAGLYLVALHRYLKVKMQNYDIEQHLGGATYLYLRGMNGEAEQGYYYWQPSTEFVLRLDAILGYFAEDKIA

SEQ ID NO: 7875 - protein, 86 aa, Acinetobacter baumannii
YLSSAESPFAKQLADEDQLISLNALHMKQVELVVALIGEFAQLDVALGSNIGIMPTPARRGHKGQLETLLVQQISPVGQVFLFALG

SEQ ID NO: 7876 - protein, 186 aa, Acinetobacter baumannii
LSRLSGKRAMKRWYIIHAYSGYEKQVMRSLKERIQRSAVADSFGDVLVPTEEVVEMKDGKKRKSERKFFPGYVLVEMEMNDDTWHIVKECPKVLGFIGGTPEKPAPITQREADAILARVRNTGEAPRPKTMFEPGEELLVIDGPFTDFKGVVEEVQYDKSRLTLTINVFNRPTQVELEFRQVEKTI

SEQ ID NO: 7877 - protein, 480 aa, Acinetobacter baumannii
IKRLEQWTMSEQQPKFEIRDEEQLSVDLIEAQYALKESRGKPNAKSTLILMSGIELAGKGEAVKQLREWLDPRYLRVKADAPRVLTDSEAFWQSYSAFIPTEGQIVVMFGNWYSDLLVTATHVSEPLDDARFDAYVENMRAFEQDLKNNYVDVIKVWFDLSWKSLQKRLDKIDPSEQHWHKLHGLDWRNKKQYDTLQKLRRRFTDDWYIIDGEDEKQRDQFFAQYLLQHMRQLPEHETEVKGKWQQAKIPESLLKPAQEKMDKAEYKKELDKLSKKIADTMRFDKRNVVIAFEGMDAAGKGGAIKRIVKNLDPREYDIHCIGAPERFEARHPYLWRFWNRINEAEKITIFDRTWYGRVLVERVEGFASPIEWQRAYDEINRFEKDLFDSQTIVVKIWLAISKDEQEQRFKAREETPHKRFKITAEDWRNRDKWDDYLKAAADMFERTSTEYAPWYIVATDDKYTARLEVLRAILKQLRAD

SEQ ID NO: 7878 - protein, 174 aa, Acinetobacter baumannii
MKLSNKSQALYDMIAPAVEACGVDLWGIEFLPQGKRSLLRIYIDRPVDENAEPVINEDGEVEQGRGIGVEDCVRVTQQVGAMLDVHDPISGEYALEVSSPGWDRPFFQLEQLQGYIGQQVALRLIAAVENRRKFQAKLLAVDLENEEIQVEVEGKHVLDIDSNNIDKANLIYQD

SEQ ID NO: 7879 - protein, 360 aa, Acinetobacter baumannii
LLQSITYQILNEKIMAQQRLSFLDRNLTLWIFIAMGVGIAIGVFLPQASVTLDKMSVDSVNIPIAIGLILMMYPPLAKVDYAALPQVFKDKRTLTLSLVQNWIIAPVLMFALAIIFLHSYPEYMTGLILIGLARCIAMVLVWNGLACGDNQYVAALVAFNSIFQILFFSTYAWLFLTFLPPYFGIAGQVINVDFWTITHAVLIYLGIPFFLGFLTRLILVNAKGLEWYQNVFLPKISPLSLLALLFTIVAMFSLKGGDVVSLPLDVIRIAIPLTIYFIVMFFISFFMSKWMGNDYPKTTAISFTAAGNNFELALAVAIATFGLASPVAFTTVIGPLVEVPVLIALVSVSLWLRKKYFESV

SEQ ID NO: 7880 - protein, 390 aa, Acinetobacter baumannii
MATLNPRDVVIVDGVRSAMGKSKNGMFRNVRADSLSAELVRALVARNQFDVNEVEDLIWGCVNQTLEQGMNIGRNIGLLAGLPKTVAGQTVNRLCGSSMQAIHTAAAQIATNQGDIFIIGGVEHMGHVGMMHGIDLNPEASKHYAKASNMMGLTAEMLGRMNGITREEQDAFGVESHRRAWAATQEGRFKNEIIGVEGHDANGFKILCDIDEVIRPDANLEAFKALKPVFDPKGGSVTAATSSALSDGASAMLLMSAERAQALGLKPRAVIRSMAVAGCDAAIMGYGPVPATQKALKRAGLSIADIQTVELNEAFAAQGLSVLKGLGLYDKQDIVNLNGGAIALGHPLGCSGARITTTLLNVMEQQDTQIGLATMCIGLGQGIATVIERV

SEQ ID NO: 7881 - protein, 573 aa, Acinetobacter baumannii
KEFLVPHDVDLIILLAVGFGVALFFGYIAARLRLPPLIGYLIAGIIISPNTPGVEADIHLANQLAELGVMFLMFGVGMHFSLNDLLLVRRIALPGAILQIAVATLLGIGVSMLWGWSFGSALVFGLSLSCASTVVLLKALGDRGLLDSVNGKIAVGWLLVEDLVMVLVLVLLPATAVLLGGKAPAGAEGNIWLTLGITLLKVIGFIAFMLIVGKRVVPIIMQFVARLGSRELFTLTVVAAAVSIAYGSYAIFGVSMALGAFFAGMVVKESDFSHRAEEETLPLREIFSILFFVSVGMLFDPHILIERPLHILAVIAIIMVGKTLAAMALVLFFRYPINTALTVGASLAQIGEFSFILATLGVSLGLLTLEAQNLILAGALFSITLNSFIFSAIEPVQRWIRERSHLARLLERSGDPLAMLPDEVDQSYLRDQVVIVGYGGVGRRITENLINQNIKVVIAEENREIVEKLRQANIAAVSGVATEPGVLIQAHIMHARLLVISPMDILDIHRIVDIAKQLNPQIQVLICAESKEEAAVIRDEHIGEVFYAKEEMAKNMSHHILNQIELAHQSTHH

SEQ ID NO: 7882 - protein, 648 aa, Acinetobacter baumannii
SFKSSFEILENIMAYITLRDVQLAFGGPALLDGANFNLERGERVCLIGRNGEGKSTLLKLIEGSLLPDSGEVSVQNGLTVSMLAQDVPMSSGKVADIVAEGAGEAAAVLKAYHEASDACVLGDMEACDRMGSLQHKLDQLDGWALENKVNTILGKMELDPNADLADLSGGRKRRVLLARALLTQPDVLLLDEPTNHLDVESIEWLEKFLLDQNNLTLLFISHDRSFVDRLATRIVELDRGILRSYEGNYSRYLDLKAQQLEAEEKQNALFEKKLAEEEAWIRQGIKARRTRNEGRVRALKALREESKARRFQQGKVNMGVQEAQRSGKLVFDIEHLSVSYDGQTLIRDFSAIVMRGDRIGLVGDNGVGKTTLIKAILGEVQHEGVVKTGTQLEIAYFDQLRNQLDLEKSVSENVSEGSDFVDVNGQRRHILSYLQDFLFSPERARTPVKALSGGERNRVLLAKLLLKPSNLIVMDEPTNDLDMVTLELLEEMLSEYKGTLLLISHDRAFMDNVVTSTWVFDGKGGIAEYIGGYQDYLIQRPNERVVDQKGDVKKAQAKAEAEKNAAQTNVKKVKLSYKDQRELEQLPAEIEKLETEQAELSDKLADGSWFVTDADAATKASQRLAEIEELLLEKLERWDELEQMSKGN

SEQ ID NO: 7883 - protein, 161 aa, Acinetobacter baumannii
SWKSNMGHVDYDSTLIVGSFIAAGAICYIVISMEQLIFKQTYKKIEPFILLLNGLLLAAAISIVHIVGMHAYHLFEAASSNVPLITLAFGISAVLSSVAIWLTSRFTLPIFRLILSSIIMGIGISASYYVSMLGWNIDIYKKDYTSFLILFSVLIAMRGRD

SEQ ID NO: 7884 - protein, 287 aa, Acinetobacter baumannii
YIESLGKIMQEEPSPSWGMRGLRKWLGTAPETRDELLKLVQNSRRFLEPDTVAMLEGVLDLPATKIREVMTPRTAMISMQEDDQLLDILHVLVESAHSRFPVFSADQPDNVVGILLAKDLLPFLTEPNTKLDIGSLMRQPLFVPESARSDQVLRMLKHTQTHIAIVIDEYGSTAGLVTLEDILEEIVGEIEDEHDTADEDAQYIVPDNDHTIANAWMVQALTPIEHFNTVLDADFSDDEVETVGGLLLQEIGLVSDLQGQTVELGNWLFTIVEADARTIHLIRAVRQ

SEQ ID NO: 7885 - protein, 1407 aa, Acinetobacter baumannii
ARLPDTRRKKLKDLLDIMRKKTDSDGHAPVEFDRIRIGLASPEMIKSWSHGEVKKPETINYRTFKPERDGLFCAKIFGPVKDYECLCGKYKRMKYKGVICEKCGVEVTTAKVRRERMGHIELASPVAHIWFLKSLPSRIGLLLDMTLRDIERVLYFESYVVTDPGMTPFEKYQLLNDEEYFTALEEHGDEFVAKMGAEAVQDLLKDIDLEAEISRLREEIPQTTSETKLKKASKRLKLMEAFKDSNNKPEWMVMNVLPVLPPDLRPLVPLEGGRFATSDLNDLYRRVINRNNRLKRLLDLAAPDIIVRNEKRMLQESVDALLDNGRRGRAITGSNKRPLKSLADMIKGKQGRFRQNLLGKRVDYSGRSVITVGPTLRLHQCGLPKKMALELFKPFIFAKLQASGQATTIKAAKKMVERETPEVWDVLASVIRQHPVMLNRAPTLHRLGLQAFEPILIEGKAIRLHPLVCAAFNADFDGDQMAVHVPLTLEAQLEARALMMSTNNILSPANGEPIIVPSQDVVLGLYYITRDAVNAKGEGMVFADTHEVNRALATGQVAIHARVKVRVHQTVINENGEREQQTIIVDTTPGRCLLWEVVPEGLSFDMINLEMTKKNISKLINSCYRKLGLKDTVIFADQLMYLGFRQATRSGVSVGMEDMLIPPTKHTIIDKAETEVREIEQQFEQGFVTAGERYNKVVDIWARTNDQVAKAMMDNLSYTLVKNKQGEDEKQKSFNSIYMMSDSGARGSAAQIRQLAGMRGLMAKPDGSIIETPIKANFREGLTVLQYFISTHGARKGLADTALKTANSGYLTRRLVDVAQDLVITEPDCGTSGGLVMTPFIQGGDVIEPLRDRVLGRVTAEDVRRASDDEVVLPRGTLIDEKIAAQLEEAGVDEVKVRSVIACESTFGVCAKCYGRDLARGHLVNPGESVGVMAAQSIGEPGTQLTMRTFHVGGAASRTSAANSVQVRNKGTVRFHNVKTVQHAKGHLVSVSRSGEIGIADELGRERERYKLPYGASILLKDGELVEAGGIVATWDPHTHPLVTEVAGKARFSQIADGVTATSKTDDATGMTTVEILPVTARPASGKDLRPAIVLDTTDGGEQFYFLPQNTIVTVRDGETIGVGDVIGRVPQESSRTRDITGGLPRVADLFEARKPKEHAILAEVSGIVSFGKETKGKNRLVITPDDGSEIYEELIPKWRQINVFEGEHVNRGETISDGPQNPHDILRLKGEVALTNYIVNEVQDVYRLQGVKINDKHIEVIVRQMLRKVDIIDGGDTSFIKGEQVDYIRVVQENQAVLAQNKFPAKFERQLMGITKASLSTDSFISAASFQETTRVLTEAAVTGKEDDLRGLKENVVVGRLIPAGTGLAYHLERRRQEAEAAEHALHNDFSEVDQAFSQALNSEQF

SEQ ID NO: 7886 - protein, 126 aa, Acinetobacter baumannii
RLSPPIVIALFSKNWSRTMSATIVNTTDDNFQADVLDAETPVLVDFWAGWCAPCKAIAPVLEDLSSEYAGKVKIVKVDVTSCEETAVKYNIRNIPALLLFKNGEVVAQQIGAVPRSKLVSFIDENV

SEQ ID NO: 7887 - protein, 385 aa, Acinetobacter baumannii
IENPAKKRVLNQAKVRVKKQKPRSLRKILLLSLKAILYLKLYDTIFQQLIQEKQFSAAEAQVNQALKKDNTQHELYLLLLEIHIAQKDEFAIQQLISHIRSLGLNEIAAQAETRQKEYESSRQPDAIDFPQAQTYEEPKNTDTTAQFDELTTSSSEASFNDLKKDYTPVKQEPAVEIEPLEFNFSFEQTSATENTNQPAQQPELSSTQETNELADLEFSFDLAPLHETEEKSQAVEVKADQENSINALDFNLDLNPSSPETKSVEQAPSLDEIKLIEQTPLEATSIAPLEFSLDEPALVTAPEIEIQNNEVVNERVTQTQIEDPLLEAFPELKQINENELDLKLAEQYIKFGANQAARNLLQSDEQKFNTEQQQHAKNLLNRIAS

SEQ ID NO: 7888 - protein, 115 aa, Acinetobacter baumannii
PLLLPTTTIPSAASTPELKPNLLTFFSQRRCLPRYAATSPLGSRVKTTPSLASSCKRNGSALFVEETLRENTGTKLLFDSVNFGSGFGFASFTLLLEHPTNTADAIAIAKGSLNF

SEQ ID NO: 7889 - protein, 269 aa, Acinetobacter baumannii
GQTLSTPKLKIMLCMGVAVALLTSGCQTSQTVKKDPEKAVKVRTQLAAEYIRSGDLDSAKRSLDQALSVDSRDATANMMMGILLQQEGSKPNLEKAEHYFKRAISSEPDNAQARNNYGTYLYQMERYNDAIEQFRIAGATLGYDQRYQALENLGRIYLKLGDIASAEKTFKQALLANRDSYISMLELAEIFYLQQQIPAATQMYEQYVRTVGQKNQGARALWIGLRVARANADKMGMQVLVNQLRALFPESPEYQRYLQLQYSTEAVWK

SEQ ID NO: 7890 - protein, 605 aa, Acinetobacter baumannii
AVMFDFLSFWQANTPIFSILIPAFTGFILLLLGNPGAGALKEDWRQPWRRGISLISAIAGLITAVSYLLVANTGQITVYQLSEWSAPFGIVLVLDRLSAFMLVLTYALAVPVLWYASENWDTRGRYFHAIFHFLLMGLCGAFLTGDLFNLFVFFEILLMASYVLLLHGQGKPRFQLGVHYVIINLLASALFLIGLGMIYGSVGSLNMADVSRLLPTLDADQHKLAVAGALLLFVVFGIKAAMLPVGFWLPKTYAVASTPVAAIFTIMTKVGIYAILRVNGTVFNDVLSQEIFKSWLLPIGLVTSLYGVIGAIGADRLRRFVGFMVLSSIGTLLIAIAMSNTQAWSGALFYLVHSTLIGAAFYLFCGWMTSQRGDFKDHLKIAPRIKQEKAAMLTYFLIAMMLAGLPPFSGFFGKVFILQATVETAYQGWVIGIVLLVSLLSIIALTRVGFILFWRASPPEEDPINPAYIIYRALPEKAPPRNDTVIYILLAGLVAYVAFASPVLHYTTNTAQQIQDHALYQQSILKTDQNGEVISVQPYDSTYLPETKYGGEVEDHNAYLIPDIISKDTFNGEHISEYKHRQIQQQEKLQTPTIADESQLKPMEP

SEQ ID NO: 7891 - protein, 342 aa, Acinetobacter baumannii
NAVFYYIFKFVALRVTMSLEALTTEALAAIAAAQDLVALDQVRVQFTGKKSQLAEQSKALGKMDPEERKVQGAAIHAVRETINNALTERQTALQQAALAQKLASETIDITLPGRGQRVGTVHPVTQVQERICQFFTKAGFTVATGPEVEDDYHNFEALNIPGHHPARAMHDTFYFDANHLLRTHTSGVQIRTMETSQPPIRIVCPGRVYRCDSDQTHSPMFHQIEGLYVAENTSFAELKGLLINLLNEFFEKDLKVRFRPSYFPFTEPSAEVDIMDERGRWLEVLGCGMVHPNVLRAAGIDPDKYKGFAFGLGVERFAMLRYGINDLRMFYQNDVRFLRQFA

SEQ ID NO: 7892 - protein, 533 aa, Acinetobacter baumannii
SRCPHYSSDSSCTSMRAYFEKLLDSSQQQKQLPLIFPLLIALFSGAVFSFALAPYYWWWLAILSPALLYATLHNRSAKQAFAIGWSYGFGLWFVGAFWLYTSIHVYGDTNAFLSVCMIAVMALVMGLFTAFQTWIYRRFFPETPLTFAPLWIIFEWAKTWVFTGFPWLFVGYAFTERLLDGYAPLFGIYAISFVVIVLACALVEVLRKRIFWVIPAALLVLGAWGASYIQFVQPKAAKPLSVSLIQGNIPQDLKWLTEYQVRTLEIYAGLTQSEWGRDLIVWPESSIPLFQTDIEPFLDAMDAQAKKNHTAWVTGIPYWDVAKSHQVGSPLYYNSIMASGSDSSGLYKKQRLVPFGEYIPLSGLLSWVLPAMQNDISMSGFTRGESDQKPLLIKGHALAAAICYEVAYPNLTRRNAEDSDFLVTVSNDAWFTGTAGPWQHLQMVQMRAKENGRWFIRATNTGVTAFIDQNGHITEQAPIDKEFVLRGDLPAMQGQTLYNRLGDYPILGFAVLLLVLGWIYRPRKVDVSYKSRR

SEQ ID NO: 7893 - protein, 380 aa, Acinetobacter baumannii
EISPVCLTDWAFDFVYDNKEGGSDTLSQLQAEVDVVIIGGGQAALATAYFLKRKKIPFVILDDQNQAGGAWLHAWESLRLFSPNTWSSLSGWMMPKTEQTYPTRNEVIQYLSAYEQRYQFPVIRPIHVDHIEKKNDCLDVYAGDKYWRAKAVVSATGTWSQPYIPHYEGLERFKGIQTHSAHYVNPEPFINKKVLVIGGGNSGAQILAEVSEVADTIWITVTPPQFLSDDVDGRVLFLRATERLKAQQEGRIVDQPIGGLGDIVMIDSVKDARERGVLHSREPFKAFKEHSVVWEDGSTQLVDAVIWCTGFKASLNHLRSLRVIEPNQTVAVNDGRSIKINNLWLVGYGEWTGMASATLIGVSRTAKAVVDEIAVYLAID

SEQ ID NO: 7894 - protein, 244 aa, Acinetobacter baumannii
LSQPDWRYCCCSPRFQTVRDSDMWSILALGAVERIIHHLIDLDALTRIQLNQLQGKMLRVIIDSPQLSVDVFFDQEKVRLEPTVTGHSEKPSIFEQRPFDPQFKISEATATLHVKDVVELIKLLLSDPDQIGNIPLQGDYHLLQDIQKIMQQAEPDLAAHLSKWVGPQLAHEIGKIQLAPKHLKRSLQSHLFFAEDALKEDSGLFAPRWEMDDLNQATRKLNQDIDRLEAKLQQLNAQLQPTQD

SEQ ID NO: 7895 - protein, 81 aa, Acinetobacter baumannii
MTKPPYHDDQASFSAPIEDLQVRIAFLDDLVEELNQQLAIQTLEIADLKKQMQLLYQRVESADLSEGVAPFDPLTNKPPHY

SEQ ID NO: 7896 - protein, 188 aa, Acinetobacter baumannii
LDKPYCNRQEIEEKTMQQALFGGGCFWCVEAVFLQIRGVEKVTSGYAGGHTTHPTYEQVCQGDTQHAEVVLIDFDEQQVTYSQLLDVFFATHDPTTLNRQGNDIGTQYRSVIYYFNEEQKQAAEHTIQTLKDDDLDIVTELSPAPTFYPAEDYHQNYYEKNPSQGYCNFAIPPKLLKLHSKFQHLMKN

SEQ ID NO: 7897 - protein, 452 aa, Acinetobacter baumannii
TFRPLAMPKIKPIKLVIIVVCIAIIAVLAWKFLKPKQQQPQYITAEVTRGDIENNVLATGTLDATKLISVGAQVSGQVKKMYVQLGDQVKQGQLIAQIDSTTQENSLKTSDANIKNLEAQRLQQIASLNEKQLEYRRQQQMYAQDATPRADLESAEAAYKTAQAQVKALDAQIESAKITRSTAQTNIGYTRIVAPTDGTVVAIVTEEGQTVNANQSAPTIVKIAKLQNMTIKAQVSEADIMKVEKGQQVYFTTLGDETKRYATLRQIEPAPDSISSESNSTTSSTTSSAVYYNALFDVPNTDGKLRIDMTAQVYIVLNSAKNALLVPSSALSSKQFSGQRKQQGQSADKASSTPSAERKHQGNGARLERLNLTPEQKQLIEQGKATLSVVRVLQADGTTKPTQILVGINNRVNAQVLAGLKQGDQVVIADSSENSAASANSGNNRRRGPMGM

SEQ ID NO: 7898 - protein, 562 aa, Acinetobacter baumannii
FGALDAFMLTHLTLINFALADHLAIDIEQGFNVLTGETGAGKSLLLDALSACLGERTDTNYVRYGSDKADVTAVFTYQDNSPEAKWLKEHELDDDSGEIHLRRVIFATGRSKAWVNGRPSSLSELKELGRLLVQLYSQHSQQQLLEPPYPKHWLDRYSNFYAEANDVREAYSTWQRNIRQHQAALDAQATRLQRIATLELQIEELEEVIQTDYKEIEQEFDRLSHHEHIMQDCSYSLNALDEAEQNITQEMSSIIRRLESHAGRSEQLSEIYNSLLNAQSEIDDATSNLRQFIDRQSFDPERMEELNSKLEVFHRLARKYRTQPETLKEEYETWQSELEQLHQLEDPETLAEQVEKSHQEFLEKAQHLDNIRREAAAPLAKQLTEQVKPLALPEAHFEFKFEPLEQPNAEGLSFIQLLFTANKGIPPQPLARVASGGELSRIALVMQVMNAEKTEAEVLVFDEIDVGISGGTAEVVGRLLADLAQHVQLLCITHQAQVAAQSDQHLLVKKQQTDPASSTIVQLDENQIISELARMSGGVEINETTLQHAKQLRQLKFQASST

SEQ ID NO: 7899 - protein, 149 aa, Acinetobacter baumannii
SGAFKESLLWRLLLLFFHLNRYLINRLIFMLAYWYNAPRHIKLIFIIVVCAAIYAANQVQPLSPTYTVLSLVLGFGLHFGQYLQTKIPEHSSHKLKLQFLLRIYPLIIVAIIMWLLPPQHNWIATIQALGFVLVGFFLVSIYQNRAKRF

SEQ ID NO: 7900 - protein, 464 aa, Acinetobacter baumannii
LGEPMKLESIQFKHIALFHDLKIQFQYDKQPITLILGEQATGKSMLLKHIYHALTWFPARLKDARTPGIVMPDQDISHSRLQSKIEVSIQIPPEFGQLPETASTQQTDTSLCSWKLFKTLNSSGVGISQVETQQLDQTITLYHQVTRKDPLQGLPLLAYYPSERFVNDINLLNKNLPGITQSISAYDISFIPFTTFARFFEWLREISDIENAQAAHVVQRIISKQSNSQDQEEILRQLQLELAGHPKQLPSPNLYALKSALKIIFPELEDFYLQYHPKLQLMAHYKGEVLAFQQLSNTTKTWIALVGDVVRRLCLLNPLSLDPCLEGEGVLLIDQIDSQLDAAHCSEILNRLHRAFPRLQIIVTGSREELLEHAAVYQCFKLEHGKISPLDLSTTQQQLEHLYTLLQRDEALTPHIDPLPLDTEPATTQIDSLYQQIQNLNEQQKNELLRMIHAGDTSEETSSL

SEQ ID NO: 7901 - protein, 94 aa, Acinetobacter baumannii
YDWPQICCWLNQWSYTMSKVCQVTGKRPVVGNNVSHANNKTKRRFEPNLHHHRFWLESEKRFVLFRLTTKGMCIIDKLGIEKVVADLRAQGQKI

SEQ ID NO: 7902 - protein, 255 aa, Acinetobacter baumannii
CFKFIYYKKRAFMQSNNPILTRVETVSDYSQPMTVQGAIQKSVMLTIIAAAVGVALFFYAAFTANIGIAYAASIVGAIGGLVLALITTFKPTTAPTLAIPYALFEGAFLGGISFTFQLKYPGVPLQALLATFVTTLVMFGLYKFQIIRATEKFKSVVISASLAIFIVFIVQMVMRLAFGSSIPYIFESNWLGIGFAAFVAVIASLNLILDFDLIETNAAYRAPKFMEWLCGIALLATLVWMYISFLRLLGLLSDD

SEQ ID NO: 7903 - protein, 69 aa, Acinetobacter baumannii
LFFTNLKLQLILIKLSIFQTVKFNQIIRTILQLKVIKTFTFPSQFYRQIQLTQTVHINKNYYYSHNVYI

SEQ ID NO: 7904 - protein, 272 aa, Acinetobacter baumannii
SQITANLDLKTLKQVIIGTIIMTTHSLKDKVVLITGGAKNLGGLISRKFAEQGAKLAIHYNSLETQADAEQTLADIKALGADAILIQADLTHIENIEKLFIDTKQHFGGIDIAINTVGKVLKKPFLETTEQEFDSMSDINSKIAYFFIQSAGRHLNNGGKICSIVTSLLAAYTGFYSTYEGLKAPVEHYTRAASKEFGDRQISVTAVAPGPMDTPFFYGQESAEAVAYHKSASALGGLTKIEDIEPLVRFLVTDGWWITGQTIFANGGYTTR

SEQ ID NO: 7905 - protein, 564 aa, Acinetobacter baumannii
NLITGASSGIYKRHTNNKVLRRMNQLNNLQHKFPVVDGIPESVRLPSQIHQRVSLVDGELKLWAGATKKTLSPIWIQQPDGSLQQVELGSYPVMGEKESDEALEAAVRAYNNGRGEWPMMKVSERIACMQNFIQRMVEQRDLIIKLIMWEIGKSLADSEKEFDRTITYMRQTIDALKDLDNANSRFVIAEGTIGQIRRTPLGVVLCMGPYNYPLNETFATLIPAMLMGNTIIFKPPQFGTLLFEPLLEAFRDSFPKGVINTIYAPGSLVVPHLLASGQINVLALIGSSKVADHLKKQHPKSHRLRAILGLDAKNAAIILPDADLDLTVKECLLGALSFNGQRCTALKMLMVHRSIADEFVNRLTTELAKLKVGMPWEKGVSITPLPGMHRTAYMTEVIEDAVAKGAKVVNPEGGEFCKTMFYPAVVYPVTEGMRLYREEQFGPVVPVAVYDDIETVLDYVTTSDHGQQVSIFGSDPAQIGHLVDTLVHQVCRVNINCQCQRGPDVFPFGGRKDSAEGTLSVHDALRAFSIRSMIAAKQTDDSKGMLASMVSEHYSKFVNTDFIF

SEQ ID NO: 7906 - protein, 378 aa, Acinetobacter baumannii
YHELSDTMIENPIKRRPTRKIRVGSVYVGGDAPISVQSMTNTETCDVDATVAQIERCVDAGADIMRVSVPSMEAAEAFGAIRKRVSVPLVADIHFDHRIALAVADYGADCLRINPGNIGSDQKVREVVAAARHHGISMRIGVNAGSLEKDLQKKYGEPTGQALLESALRHIDILDRLDFHEFKVSVKASNVFLTMDAYRLLSQQIDNPLHLGVTEAGIYRTGTVKSAIALGGLLMEGIGDTMRISLAAEPEDEIKIGFDILKSLGLRSNGINFIACPSCSRQEFNVIQVMQALEERLEDIRTPMDVSVIGCKVNGPGEAKEADIGVVGAAPRSLVYRNGEKSHLIDTNQLVDEIETMVRQRVQELEEAKSKEIIRSSS

SEQ ID NO: 7907 - protein, 778 aa, Acinetobacter baumannii
KHELHIQENGMVTVREQLPEQLTELSEETTVEHAAETQVGLASWLDRVREILDGAELKQLEEVAHLTLQKELDSTVNHRSNTFATGVGMADILAHLHVDEDTLSAAMLYRSVREDITDIEEVKRKFGEQVYNLVKGTLAMGKLSELIEKNKRLEDHFNNNQREHLSGIYKMLISVTEDVRVVLIKLAERTYSLRELANSSRERQERVAREILTIYSPLAHRLGIAQLKWELEDLAFRYLAPDRYKEIASLLNEKRLEREHYIQFVIDRLKSELAAHGIEAEITGRAKHIYSIYRKMKSKNLSFDQLYDIRALRVLVNSVPECYHSLGIVHQIWRHIPHQFDDYITNPKANGYRSLHTAVIAENKSLEVQIRTHEMHDEAELGVCSHFNYKEGSKNTDHSFNHRLHSLRAVLEHYQERNETTVHQNEDETEGFDQLQDFEGFEKIYVFSRDGDIKELPRGSTVLDFAYHVHTEVGNKCYAARVNQRYVPLTYTLKTGEQVEILTKKDREPNRDWLVNSLGYIKTARARDKLRHWFRQQDRSKNLEVGRELLNKELSRLAIHPKSIDLNDYSSHFNVKTGDDILVSLVSGDISLHALINQINRQMHLDQDEPELVLKPTLNPRASHTLSAHGILIDGLDNVELHIAQCCQPVHGESIAGYITLNRGVSIHKVLCSDYQRMIKQEPERAVEADWEMQPTRGQSVQIVVEAYDRRGLLKDLTQVIFSDQINIRQVNTISEADGIANMKLLIEVKGLAQLSRLLARLEQQPGIISARRMIQGV

SEQ ID NO: 7908 - protein, 329 aa, Acinetobacter baumannii
KRTTISSMYFIKPTRSIPFVEQALEALPDLQVIHIDDLDLYDPTIIAIADVQDFLTYKWRLPTIVIAFEHEGSALAQAWEAGALAGWVWNQLPNDLNKALTRIDAQYKRNQDSRDLPSAAELQKRLLPNPIDLLNYEVETFFQPSAYLSGDWYDYWKLNDKEVLFYLADVSGHGVTSSLLTSWMAAFHGRSKTPRQLIKKLNGMLVQENIEKHITIVVGILNLETHSLRWSSAGHYPPPIIFEPNQPPKILTTSSFPLGLTDELEVEEHVCTLNRHARFIICSDGALEPFDGGLNDQFQQLVQHLQNQSFQAPDHVADDIAIFSLCRMN

SEQ ID NO: 7909 - protein, 548 aa, Acinetobacter baumannii
NMELFHMVSAYNELPRTPANFVALSPLRYLERAAYIYPDQASIIHGNRQISWKQTYQRCRQFASQLQQLGITKNDTVSVLLPNVPAMIEAHFAVPMAGAVLNTLNTRLDAKTIAFMLEHAETKVLLVDPEFVNLAREALSLIPNQHIIVIDVADEEYEGENQFLGSFEYEEWIAQGDANFEWHLPQDEWDAISLNYTSGTTGNPKGVVYHHRGAYLNAASNILACGMKPRAVYLWTLPLFHCNGWCFAWSIAASGGTNICLRKVDPELVMQLIAKHKVDYFCGAPIVLSMIINLPKEKQPIIEHYVEVMVAGAAPPVAVIEGMRNIGINVNHVYGLTETYGPSALCASQAGWSDLSITEQAQLHSRQGVPYPLQDSMRVLDPETMQPVPNDGETMGEIMFRGNIVMKGYLKNPKATEEAFAGGWFHTGDLAVCHPDGYAKITDRSKDIIISGGENISSLEVEDVLYKHPAVLTAAVVAKPDERWQEVPCAFIELKTGASATPEEIIEHCQKELARFKVPKDVVITEIPKTSTGKLQKFILREWAKERA

SEQ ID NO: 7910 - protein, 368 aa, Acinetobacter baumannii
QFFTVLMKFIHHEKCIRQQKDKTYKIIASSMRSIIMALNQIWKQQLTLVTYGNEYLRQNLSFSQWRQHHIFDQHSFQFRDLISQHLLAQHFQVWLEALKKQGTTQISLHLSTILNEEQNPNSNVELLPYAHFIVSHQNNKKIAWIFGHELAEWYSSDNEFEPPLTQRSDLRLETFWRFELNEKLSKKVEADLKAPQWDEIANFMETELFRSKYAAGFEEPEFQKKYFDGSTHQISVEHQPTLALIPESYPADCAHQLLYRTQALSDYLEQKKRTANDPLGEDLDQEQIINLRNFTHKTDDLFAKLIVKAANHYQTAQLKPIEKPSPFDATNESAAHLKVPHHKAGGTGVIKLIVLTIIICALAYYFGL

SEQ ID NO: 7911 - protein, 286 aa, Acinetobacter baumannii
ANYTVSRTNYRDEIMKSIDEIKAQEVCVAILLDKKATNTQAKILPSENIIIDRLLERKVELQHAYSELYSKLGKYHQALTNFLDLLVGITSMHSPEEVIKSRAAQKKLNEINQQISIKAHELAALLETRSELINTSGFMTDTHYHIGNVIREASQNNPYFRTSLLDKLKQLQGQFDLKYWPRLDDVMKVIAEDARMAVPIAIDSITEVATIGERASLVDYFRALFEAIECNRQKEYGFLPNDFKLTDNTIATLANCALALEPKEMIDGLYVKNFRSRERKRIGSDS

SEQ ID NO: 7912 - protein, 310 aa, Acinetobacter baumannii
FGLTIRKIRTIKMDRLQQFYIFTEVAKRQSFSEVANQLDLPRSTVTSAIQQLETHYGVRLFHRTTRKVSLTQDGQRILPECQNLLFDYEQLEQLIQTQKQHYRGTLKISMPSRIVHQVIIPELPDFYHRYPDIHLQLNSSDDLTDLIEKGIDCVVRVGELDNSSLIARFIGHLVMVNCASTQYLQDYGIPEQLNDLEQHKLINYAGAVGEKQGEFIYQGGTVMMDSALSVNNTEAYIAAACAGLGIIQLPYYDVQDKIEQGILVEVLSAYSAPSLPLNILYPNRSYIPKRLEVFMNWVGEVLNRKCIVIF

SEQ ID NO: 7913 - protein, 193 aa, Acinetobacter baumannii
DKTTMGANSALIFGILINVAILLVFFRFLMQLAAVSPYNPVVLSTVKATKIVDIFGRIFPTVAKGRFNLAALVLLIILYLLKIFGVMYLSGSMPNSPVHLVILTFVTMIQDLIRFCRYLIFATIILSWVVMFTQSRSPYIEVIQDLAEPLLAPFRRLLPNMGMIDLSPILAFLALYIAEILMNEVAKVLLTGL

SEQ ID NO: 7914 - protein, 441 aa, Acinetobacter baumannii
KEQTMKTPHFAIIGAGTAGLATAILLAREGNHVTIFEHVDELSPVGAGLLLQPAGLAVFEHLGVLDKALTLGAKVTGLEGQLPDKRLLVNSHYREASTNLYGLGIHRATLCHVLTQKLSEYSSQITWCMNHSVESFVEHNDEVRIFGSHQNQKFDACFDGLLIANGARSQLRPKAWVKVDKAYPWGAAWSIVPECQVLDSEILHQFYDRSKIMMGILPTGAIPTEPQQRLSSVFWSLPTPQLQSFLQDEQAKQAWLKQVSERWPKVADWLKEILYNSQTQPKWLSANYRDVVMTQFGQGRIGVIGDAAHAMSPQLGQGANMALLDAWAFSQSLQHAQKNQNIDWSLLWQHYHQLRGSSTQFYQFLSRLLTPLYQSDDWWAGGLRDLVFPWMYQIPYFRKEMAITISGLKTGPFRHLEYDQVAQLPKENSTFHLKSESLTDF

SEQ ID NO: 7915 - protein, 370 aa, Acinetobacter baumannii
RQKTMKVMQLLPELNSGGVERGTLEIARALVAQGHQSLVVSNGGRLVSQLEAEGSTHLTLPIHKKSLSSLWQIRPLRQLIEEYQPDIVHVRSRVPAWLTHFALRKIPANKRPHLISTVHGFYSVNRYSAIMTQAEKVIAVSDSVVKYITDHYKNCPPQDIVRIYRGIDPAAFPHNYQPSAQWFNQVFNDFPELENKFLLCLPGRITRLKGHESLIELMQQLHSQYPQLHAVVVGGADVKKQAYLSELQNTIQSKGLADKITFVGHRSDIREWLAFSDIVLSLSNQAETFGRTALEALSVGTPIIGWNRGGVAEILSHVYPQGLVEAENEKALLEIVKHHIEQPQTVAPVTMFSLKDMCDQTLELYQSVLK

SEQ ID NO: 7916 - protein, 283 aa, Acinetobacter baumannii
FMKTETTIQGLAASLNPARAARKIIGFVPTMGNLHEGHLTLVREAKKLCDVVVVSIFVNPTQFGPGEDFDNYPRTLEQDSRLLADVGCDIIFAPSVEQMYGTQPRLTNISVSQITDDLCGSSRPGHFDGVALVVTKLFNIVQPNYAFFGQKDYQQLAVIRQFVQDLNIPLEVIGVPIVRAEDGLALSSRNGYLTPEQRQVAPVIYQGLKQAEEQLHQGKDLQQVLADLKTLLTDNGFVVDYVEARQPNLLAASQFDRDIVLFVAAKLGGTRLIDNLQVAFTPQ

SEQ ID NO: 7917 - protein, 447 aa, Acinetobacter baumannii
NYRTARLRIFTMKKTLSLPKAPIGMINRHKKINPAEMNKILNQHFNAFKQAAAQGDYVKAYQHVKKAVSLVPGHPGALSDLAYTELRLRRYDDAYQHYMQAIKASGSNVNTNLYDGLTEVCHHLNKKEEKIKFGRLAISTKKELTKNEPTLNIPTHKPVPFSPNPQENIIAFSLFGANPRYCETSILNTKLAQEIYPEWTCRFYVDESVPELVQQRLQANGAQVVHVSPTQKQLSGLFWRFLVMDDPVVKRFLVRDADSIVSYREKAAVDAWLKSDQWFHLMRDSYSHTELILAGMWGGCTGIFHNIEAHIRDYVATGRYLDNRVIDQHYLRYCIWPTLKQSVLVHDSQQFDENSADFPVYDLTSMQNDQDNFHVGMDNGSPVVTTAVNHPTAEKVYWILFDENHDEVCRYDAIVSKSRNIEVNLPHAFAKKIQLQQWKLQVYPYEN

SEQ ID NO: 7918 - protein, 187 aa, Acinetobacter baumannii
NRRTTMKFKNAKIKILDLDLRGCLYLNNFSHSQRVALFFKIISRAGDGPFWYLMLAIVWGMQGITYSLQIIYLLLGGSVGTAIYKFLKHKTTRPRPYQVHQVIVLGERPLDHFSFPSGHTLHAVMVTIVLGYIQPVLLAAMLPFMVLVLSRMVLGLHYPSDVIVGALIGAAVASLIIFVAPLLGIAL

SEQ ID NO: 7919 - protein, 170 aa, Acinetobacter baumannii
KKLTIMAILKKLQNIPSISKFLFNHYPPYRGAGIHIEVMNLELCHVRVKMPLTWKNQNLVGTHFGGSLYSMVDPFYMLILMHHLGSKYIVWDKASEINFLSPGRSTVYADIRVDLAEIEQIRELAENYAPVLRTYHLNIFDESGVRIAEVQKTLYIRRKKAKPSTNKISA

SEQ ID NO: 7920 - protein, 744 aa, Acinetobacter baumannii
ASMTITPKPDSVVYRVRVAVPVHLYDTFDYTLTKAQYERAQVGSRVAISFGRQNLIGIITEKVDPQESFTGHFQLKAISELLDDEPILDEQVLNLLTWSAQYYQFPIGEVMQTALPALLRQGKPMDVLFHLWKIIPCDNAEALLKRSIKQQDAYQILKLHPAGTTENILNLSGVETATLKALQKKGLIDCTLEPHDFSPAPVQLAQMPLTLNEDQKKATQHVLNAQHQYQAFLLDGLTGSGKTEVYLHIMHEVLKQGKQVLVLVPEIGLTPQTISRFKSRFNCDIALLHSGLNDSKRLQAWQQAQTGKASIILGTRSAIYTPLPRLGLIILDEEHDLSYKQQEGFRYHARDVALYRGHLQGCPVLLGSATPSIDSYHLVETGKLTALQLNQRAGHALLPKMHLIDLKIVKKQHGISQPLIEQIKNTLARKEQVLIFLNRRGYAPVLVCESCGWQANCPHCDAHFTLHTQPYSYLHCHHCGTVHRLPDHCPECQQKSLKTLGAGTAKVEEHLQELFPDHDVIRVDRDSTSRVGSWQKIYDRIQQNKPSILLGTQMLAKGHHFPHVTLVAILDIDAGLLSVDIRAPERTAQLIVQVAGRAGRGEHKGHVYLQTLRPDHPLLTTLIEKDYRAVAKQTLAERKVALLPPYRYAVLIRAESKDRDYTLHFLNEAAEQLRQIAGDIVDIWGPIPAPMERKAGRYRAHMVILSADRARLHFYLRQWWAQLVHAPRQHQLRLSIDVDPQEFS

SEQ ID NO: 7921 - protein, 340 aa, Acinetobacter baumannii
FLMTINKTIETIKSPRISVAPMMDWTTKDYRFFARLFNPNVVLYTEMVTTGAILFGDAKRHLDYNAQEHPIVLQLGGSNPQELATCTKMAEDWGYDEVNLNVGCPSDRVQNNKIGACLMAEPDLVAGCIHSMQKAVNIPVTVKHRIGIDDMQSYEEMLHFVDTVAATGCTHFVVHARIAILKGLSPKENREVPPLRYEDVYRLKQERPHLTIEINGGIKTFAETQAHLQHVDGVMIGREAYHNPYLLAELGQLWNLEAPDRFDIMEQMLPYIEQRLAEGAPLSIITRHILGLFQNLPGARKWRQALSGGNAKTLTDVENAIHNMQAAIIRTEEYLKEHQF

SEQ ID NO: 7922 - protein, 927 aa, Acinetobacter baumannii
HCQTWEDNPMAKYSNINSFNALQTLTVGSSNYQIFSLTQAEKKLGDIAKLPKSLKVLLENLLRFEDQHSVKTEHIYALAEWLKTRTSDQEIQYRPARVLMQDFTGVPAVVDLAAMRAAMAEAGGNPEKINPLSPVDLVIDHSVMVDHFADDQAFEENVQIEMQRNGERYQFLRWGQSAFNNFSVVPPGTGICHQVNLEYLAQAVWLGEDNGQTFAFPDTLVGTDSHTTMINGLGVLGWGVGGIEAEAAMLGQPISMLIPEVIGFKLTGKLQEGITATDLVLTITQMLRQKGVVGKFVEFYGDGLADLPLADRATIANMAPEYGATCGFFPIDEVTLGYLKLTGRQSDRIALVEAYSKAQGLWRNPGDEPVFTDTLSLDMSTVQASLAGPKRPQDRVLLSEVPKTFNALMELTLKPAKEAKERLENEGGGGTAVEATKANIQHESPSCVIEGQEYPLNHGDVVISAITSCTNTSNPSVMLAAGLLAKKAIEKGLQRKPWVKSSLAPGSKVVTDYLLAAGLTPYLDELGYNLVGYGCTTCIGNSGPLPEPIEDAIQCHDLNVASVLSGNRNFEGRVHPLVKTNWLASPPLVVAYGLVGNIRTDLTTQPIGQGKDGQPVYLKDIWPSQAEIDAVLQKVNTDMFHKEYAAVFDGDESWQAIQIPKSKTYEWADDSTYIRHPPFFEGIGEPPKPIKNIEQARILAVLGDSVTTDHISPAGNIKKDSPAGRYLQEQGVEPKDFNSYGSRRGNHEVMMRGTFANIRIKNEMLGGEEGGNTIHVPSGEKLAIYDAAMRYQQEHTPLVIIAGKEYGTGSSRDWAAKGTNLLGVKAVIAESFERIHRSNLVGMGVLPLQFVDGQTRQSLNLTGHEVISIRGLSDGIQPHEILEVDVKGPNGVASHFNVLCRIDTLNEVEYFKAGGILHYVLRNLIAS

SEQ ID NO: 7923 - protein, 422 aa, Acinetobacter baumannii
EIETIKLMTSLNSSYGRSQAVPLSVFEQSKDAHIIRSDEEAIEIAKQLAQEFATEASDRDRERRLPLNEIQQFSQSGLWAITVPKQFGGAQVKYRTLAEVIKTIASVDPSLAQLPQNHLAFIEHLRLDAKPEQQQFFFNLVLRGIRFGNAFSEKHSKTVADLTTTLRKTEHGYEINGKKFFATGALLAHWIPIVAVNELGQPYAALVPRETSGVNIINDWSGFGQRTTASGTVELNQVPVREEYLVPIYQAFERPTPAGAISQFIQAAVDAGIARGAIEETIQYVKNHSRAWIDSGLEKASDDPYTIANIGDLKIKLRAAEAVLDLAGDAIDQAIANTTEEHVNQATLLVAEAKVLTTEIAILAANKLFELSGTRSTLSELNLDRHWRNARTHTLHDPVRWKYHIVGNYYLNGVQPPRHAWS

SEQ ID NO: 7924 - protein, 231 aa, Acinetobacter baumannii
KVFAVIHHIPNVLSKEQVAEFRKLMEEANWVGGKVTAGTLSASVKRNQQLSEQDPLTHHLSDIVIKAIWQNPLFQAAALPHKIIPPLFNRYDEHESFGFHVDNSIRLIRGTAEQIRTDLSCTLFLSEPDEYEGGDLVIEDTYGYHEVKLPAGDVVLYPSTSLHEVSSITAGTRFASFFWVQSLVRDDSKRHLLFSLDESIRELRKSHGDSYSEVMKLTNIYHNLIRMWSEL

SEQ ID NO: 7925 - protein, 242 aa, Acinetobacter baumannii
STVARRHDPVIRGFESSKMSLKTELVIFDWDGTLYNSVGQIVASLQHAAEEHKLTLTDEAAKSIIGLGLPEVMQTLFPEVPDLHDSILKAYGDHYIANSTNDAWFEGISELLHDLKAQGLKLAVATGKNRRGLDRVIAKTQSTHLFDVTRAANETRSKPDPLMLKEILTVTGVSVEQAVMIGDSSYDLEMAQRLGMPRIGVGYGVHSVEVLQQFQPLTIAKDVPELHNFLREYAKLSTVDVA

SEQ ID NO: 7926 - protein, 130 aa, Acinetobacter baumannii
FYYFVKRGFIMLKFMKIVALVATVAALSACSKNEASEQKKSEAPMEQMSKESSTVATAQAVGVITAIDTKENILTLDHEAIPAIKWPAMTMGFKVADPALLNGLTVGEKVDFELKIEGESQIIVAVKKSS

SEQ ID NO: 7927 - protein, 107 aa, Acinetobacter baumannii
RYYFLFSFLSAICFYFTSSRFKSNYSYADMDSFRLFNAISSLYIFPPPLEQPFIPEDPRFMWSITVSYCRLRFISDIHLNNERIALTSLCLFYFARPISHENNSYTI

SEQ ID NO: 7928 - protein, 231 aa, Acinetobacter baumannii
TAYAGVNGKHRTGYCNCGYAANRKYEQYDLITLILEIMMKVKNIQSETAMKQHSESVVSNQFEPTCHSEYSSVSDVCSSSSFGLATRSSRARMKRASGFTLIEVMVVIVILGVLAALIVPNVMGRSEKAKIDTTQITLKGVAGALDQYKLDNGHFPTMQEGGLDALINQPATAKNWMPGGYVKGGYPKDSWKNDIQYVVPGKDGHPFDLYSFGADGKEGGEGNDADIYYQP

SEQ ID NO: 7929 - protein, 233 aa, Acinetobacter baumannii
GFNASFELWMVRINKMNSKHVDIYIGKLNDFLNRKQHDFPDFRTFNEYKKQQIQHIKNKLIAQKLEIAPTDLVFAKHEYGKPYLLDHALHFNHSHSQQYYALALSERIKDIGIDVEELDRKVRLDSLAQHAFHPDEYATWQSLEQDREYWFKVWTTKEAVLKASGLGIRLDLNTLNTQAHPTNHGGLCSHDLIGTFAYQNFVFGNMILTVAWRSEQSCRGFQFPSIQIHSLDR

SEQ ID NO: 7930 - protein, 425 aa, Acinetobacter baumannii
LKNAMQDSIEQYMQKVGQQARDASRVLTSASTSLKNHALSAIYTALENNQAAILAANQIDMEKGRSNQLDSALLDRLELTPARFKGMLQGLKDVIALVDPIGEITDLAYRPTGIQIGKMRVPLGVVGMIYESRPNVTLEAASLAIKSGNAIILRGGSEALESNKAIAEAVKHGLKVAGLPEHSVQVIETSDRAAVGHLITMAEYVDVIVPRGGKSLIERVTNEARIPVIKHLDGNCHVFVEAQADLQKALPITLNAKTHRYGVCNAMETLLVDEKIAEVFLPHIAELYAEKQVELRGCPETRRILGSSVKPATEEDWYTEYLGPILAVKVVSGIDEAIDHINKYGSHHTDAIVTENYTLARQFLARVDSSSVVVNASTRFADGFEYGLGAEIGISTDKIHARGPVGLEGLTSQKWIVLGDGQIRQ

SEQ ID NO: 7931 - protein, 93 aa, Acinetobacter baumannii
KFYLFEFVMSEQPISPTVQLNTRGLRCPEPVMMLHQAIRKAKSGDVVEVLATDPSTSWDIPKFCMHLGHELLLKEEVLDEQNHKEYRYLVQKG

SEQ ID NO: 7932 - protein, 204 aa, Acinetobacter baumannii
SRYLSSECTMKKTLFSTLIAGLLSMQAHADYIAQPQSVASQAARFSTMGIHDLQKAAQAGQAGAQFYLGTRYQYGKDVAKDDKQAFTWFKAAADQGLSPAQLNVGRMYADGIGVKKDESMARKYFEKAASNGDNRASYNLAMMEEQKKNYVGAYQWYELSTRDGMLDNKVISLSEGKKTALAANLTQEQIRMARDRADKWIQAQ

SEQ ID NO: 7933 - protein, 361 aa, Acinetobacter baumannii
QNVANHCKIRLLFFNQNSNGTNMIGALMLDIAGTELTQEDIELLQAPQVGGMILFARNIESPQQVRALTDHMRQVRPDILIAVDQEGGRVQRLKSGFTLLPAMGRFGELYITQPQKALELAEQCGWLMATEVLAVGIDFSFAPVLDLNAISDVIGDRGFSKNIEDIAPLAGAFMRGMKKAGMANTGKHFPGHGSVKADSHVAAAIDSRSYDEIYNHDMQSFIKLMPELDALMPAHVIYDQVDPNPAGFSPFWIQEVLRNRLKFNGVLFSDDLSMQAACVAGGADARIQAALAAGCDMGLVCNDRSAACTALDGIAHLELPNQERLERMRGRIPQIQVGETLSLGNDWQAVKTAIEEFKNSI

SEQ ID NO: 7934 - protein, 122 aa, Acinetobacter baumannii
AAPALPPSAPPAAAPASPPITAPPKIAPTPAPIALLRTVLLLEPLALAATPAPSAAPKPAPILPPICLPTAPPAPPPIAAEPIRLLSGLAFWQPTNRVVDIKPTPAIIIIFFIKATPLLSCA

SEQ ID NO: 7935 - protein, 146 aa, Acinetobacter baumannii
NCTAKLCWRSSLMAFQLGEDHDSGMNEMNLIPLIDIMLVLMIIFLVTATVANPSIPLTLPKTTAEIIDPPPKAITISINANGEVAWDTQVISLDELQKRFQEAGQGAVKPTVQLRADKESKYDTVAQVMSRASEAGLSDIAFVSEN

SEQ ID NO: 7936 - protein, 277 aa, Acinetobacter baumannii
DQGAAMLTYPNIDPVAIHLGPLQVHWYGLMYLLAFLCAWGLASYRAKQRDGWTSDMVSDLVFYGALGVVLGGRIGYVLFYEFDKFLENPIWLFQVWTGGMSFHGGFLGVMIAMLFWCKKYQKTWFQTLDFVAPCVPTGLMFGRIGNFIGGELYGRAVTDPNYPFGMIFPTDPLHLVRHPSQIYQALCEGLLLFIILWWFSSKPRPRMAVSALFLMGYGVARFVMEFFRQPDADQGFILFGWMTKGQILTVPMLLIGLWMMWYAYQKKIYDWGPQKNS

SEQ ID NO: 7937 - protein, 320 aa, Acinetobacter baumannii
NIMAKNYYEELGVKREASADEIKKAYRKLARKYHPDISKEKDAEEKMQAINIAYDTLSNPEKKAEYDQMLDHPQGFNGFGQGAAQGGFDGARFYRQGFTGGEQADFSGFEDLFGRFGAGFGGGQQQYQRQQRSYRGEDQHASIEVDLDIAYHGSTQHITLQIPTINAYGEPEVQRKTLQVKIPKGMKEGQQIRLSGQGQSGINGGANGDLYIEIQYKDTDRVHVEGSDVYLTVDVAPWEAALGQGIEVKTPAGPLHVNLPKNAKQGQQLRLKDKGIPNKTPGHLYLILNIVFPPAHSEKEKEAYQQLAEAFASFEPRSSH

SEQ ID NO: 7938 - protein, 259 aa, Acinetobacter baumannii
DIMAISSFGKILTVLDLFSVSRPVINVDIICEELGLSKPTSYRYLKELVSADLLKRINGTSGDYTLGSKIAVLDYVSRTTDPLVQISTPFMRNIVERTELCCLLTYLNDDYCIDIHHEIFKDTELLSYGRGCPRPIYVGASPKTMVSHLSKQRMHDYYERFQHELSESGFAVDEPSFIQRMRKIKKQGFYFSQGEIDPNVSGLAVPVRFSSKEVPLALTLVASKNRFDFLNIEKLIEILQENAALIEQRFMELSEKGEI

SEQ ID NO: 7939 - protein, 393 aa, Acinetobacter baumannii
APNFGNTGGRVLMNQKFKLPLAIAIASAVLVGCSSNKVKEAKPNPLPKLTESNKSLVPVFSRSVSSTNKADPLRLQLDASEGVVFTLDPKGEVAAYRGKQRLWEKKVSKLGLSSGVEAAEGIVVVGNSKGQLFALDQATGEQKWTAQLSGALLSPSLVQSGRVITIANDGTVFAHDVSSGQQVWAYKLPNVQFSLRGQPSPVSLDPRTVLIASANAYVYAIDTISGIPRFQRRVAVSEGRSDIQRLIDIDGDPVVAGQLMVTTSFQGQVTVTDLASQRVVWSEDSSSTKRPEVYDNKVFVSSTDGKLTAYDLTTGEQLWQNDSLLNRHLSNPVVLGSDLIVGDLDGVLHLIDPTTGKLIGRSKTSGEVNTLRVIENQLYVSTRKGDLSIWQNR

SEQ ID NO: 7940 - protein, 331 aa, Acinetobacter baumannii
LLFYACKKMKKIALFYMGGTFGCIGEPLAPMPYDQFLPQLEKVIPPHLTVDCFAAPNIVDSSACTAPDWLRLIQRIQQLQLEGYQHFVVIHGTDTLSYAAATLARFLGQSCHIVITGSQYPLLNIQGDNTREFTDAIENLYLALEQVIALPVGAYLAFHHQVFHAQTALKTHTTELDAFSGLSSNVEFTPQQNELIVKDAQIEKAASFQILNWMMQPIATQHLVQQLRHLLPAPPHFLVLQGFGTGNIAVNDEFLATLDELYSRGCVPILATQVTFGGIDQRYAISAWAKTAKIVINDAHSHADLYAKALQIYLKYPTPEQWLNHWNENLH

SEQ ID NO: 7941 - protein, 248 aa, Acinetobacter baumannii
LKNLQNKLKHLEKDNHMSLSDEEQFDSLKSFAKKYGSAMISGILIALIAFFGWEYWQKRNLATSQTETAKVQQLMDEANATADNPNALASITASADKIVKDDIDSVQAIQTQFVLAKLAYEKQDYAAAEKALKKVENSKVKDEGLIQVVKLRLADAQLAQNKYDEALKTLSGDVDPAFKATVEELRGDIFVAKKDIDSAKKAYQAAWDSLLERKQERQILQIKLESVGVLVEDPQIERPILETQVEES

SEQ ID NO: 7942 - protein, 962 aa, Acinetobacter baumannii
NENFTFRLRSKLYMDTSVLPIIILLPLILGTTLVSLLQRFSRGVTALGAIGVSLTSFGLLLTQAKTVLGGASIQQSWDWLPQLGINLSFRLDALGLLFSLLITGIGTLIYIYAYYYLGPKNSLSKLYLLLMLFMAAMLGISLSNNLIILLVFWELTSISSFLLVGYWSHYEAAQRGSRMALTITGMGGLAMLGGFVLLGQITGTYEINDIVGMKDLIQSHYLFVPTLLLILLGAFTKSAQFPFHFWLPNAMAAPTPVSAYLHSATMVKAGIFLLARLAPIFIGAALYHNIVTFVGLFTLCMAACFAIFKEDLKGLLAYSTISHLGLIVCLLGIGSPLAVAAAIFHIINHATFKAALFMIAGIIDHETGTRDLRKLSGIWQLLPFTATLTMITAASMAGVPLTNGFISKEMFFTELLASLSGSTVIFASIIATLAGIFAVSYSIRLVHGVFFDGPVGKQVPNKNAHEPPIGMRAPAILLATLCILVGIFPALLVEPLVNSVTRASLMQPDFAGTHLAIWHGFNAPLIMSIIALVGGTLFYFALAKDGMIRKIDLDPRLGRLQGRILFDLFLKHLLLTSRKIKQKTENGSLQSYLFLIIAFSIVMVTLPLFNQGLTTGTRELTHAPWIAVVLWLTLFSGCWMMLWFHHERIKAVLISGAIGLVVTMVFVTMSAPDLALTQITVDVVTTVLLLMSLSLLPQLTPYESRRSRRWRDAALAIIGGLGIGWITWLILTRDHNSISWFFAQQSLPLGGGSNIVNVILVDFRGFDTFGEITVLGIAAIGALCLMDGMRVHGTTMTQGLTYRFNPSPLMFRITASWVLPLALVVSVYIFMRGHNYPGGGFIAGLITSMALIIQYIALGQDQAEQMLKAQSGRLYEIWIGSGLTIAGLTGIAAWFWARPFLTSAHVYVELPVLGKLHLASAASFDLGVYITVVGATMLLISVLGDSRHSSMSGPVPHGEKSS

SEQ ID NO: 7943 - protein, 119 aa, Acinetobacter baumannii
LLLYLIRENTMNPIKLIACGVLSLSLSSIAFAKTEQITLKANVYYGEESVVFPTTKGEVILNSYAMPAKVVPQVKPFKKGQCLEIKSKYGFFKDTGDGQYIESIQPCSKKGLATPKVTR

SEQ ID NO: 7944 - protein, 543 aa, Acinetobacter baumannii
VRLYMIPHVSRLLELWRIAAHYRLDTLFPADELPVKAKHALNIIKMHPAAWSSRERKNPLKLKEALEDMGPLAIKLGQLLSTRRDLIPPEILAQLVLLQDQVKPFDGEVAKQRIQDSLKADVNTLFARFDDQPLAAASIAQVHTAALHDGREVVVKVTRPDIRSQILQDFEILAWLGTTLESRLEAARALHLSEIIQDYRQIILNELDLSIEADNTRRMRHYFTGSTMMYVPEVYMDTKDVMVAERITGVPISDTATFDRLGMDRAQLAEKGLTIFFTQVFRDNFFHADMHPGNVFVETINPSNPRFIALDCAIMGELSKHDQMTVARMLLAVMNSNFMQLIQIVHQAGWIPPGTDQDALAREMRRTVGPMVSKPMDQLDFAGILIQVMDIARRFHLEIPPQLMLLLKTLVHVEGLGTDLYPQLDIWKLAKPILTEWVKSNMNPVKNVKELGQQLPDLLLGAQDFPSLIIDSLNGLKNQSAWQDRQLREIQQLRLQMEHQQRRSWMFGSTMLILLTIAIISPWFVSIILIVLSSLLALWRVLK

SEQ ID NO: 7945 - protein, 141 aa, Acinetobacter baumannii
TYSYIYRLIIIAQNLRKKSMKKIVFAFLCFGITTVYADNCDSARNTYDDIYCTNKIYASADADLNKNYQALRAKLNTAQRNTLKKSQLAWIRQRDAECTDSNRNSVDVQCRLQTTQERNHWLQERLRECQTVGCKTSRLSE

SEQ ID NO: 7946 - protein, 284 aa, Acinetobacter baumannii
SRTYYVLQTPVEDTIMISLSDLRKFKAEGRKFSCLTCYDASMAKAMELAEIDTILIGDSLGMAIQGRDSTLPVTVEDMAYHTAAVRRGNQHALIMTDLPFMSYATLNDALQNAKTVMQAGAQMIKIEGGAWLSETVQVLTRNGVPVCVHLGLTPQSVHVFGGYKLQARTREAADQLIADCTAVVEAGAAVLLLECVPAQLGQEIAELFPNTPVIGIGAGNATDGQVLVVQDMLGLTFGRVARFVRNFMKEQSGETAILDAFKAFHAAVQDQSFPAKEHTFQVEL

SEQ ID NO: 7947 - protein, 101 aa, Acinetobacter baumannii
VLCYNISLIKNNLGQSLMRKDIHPAYQQVLFHDTNADVYFLIGSTIQTKQTKEYQGQVYPYVTLDISSASHPFYTGEVRKASNEGRVASFNKRFARFNRKS

SEQ ID NO: 7948 - protein, 433 aa, Acinetobacter baumannii
TTLYSFLILTLMNLTELKKKPIGELIKIAEFMGLEGMARNRKQDIIFAILKRHAMNGEEIFGDGVLEILSDGFGFLRSAAGSYLAGPDDIYVSPSQIRRFNLRTGDTITGTIRPPKEGERYFALLKVNQINYDTPENSRNKILFENLTPLFPTEQLVMELGNGTTEDLTARVVDLVAPIGKGQRSIIVAPPKAGKTMLLQNIAQSIVRNNPEVFLIVLLIDERPEEVTEMERTVRGEVVASTFDEAPARHVQVAEMVIEKAKRLVEHKKDVVILLDSITRLARAYNTVIPSSGKVLTGGVDAHALERPKRFFGAARNIEEGGSLTIISTALIETGSKMDDVIYEEFKGTGNQEITLDRRIAEKRVFPAMNIKKSGTRREERLMDEDKLRKVWILRKLLHPMDELAAMEFLLDRMKETKTNDDFFDQMKRKAST

SEQ ID NO: 7949 - protein, 126 aa, Acinetobacter baumannii
GPPYFMNLAKVSELTKVSPRMLRYYENLGLIQPHRASNNYRSYTQKDIENIKKIKILNDAGMNLKDIHVLLPCFDLDERVFTLCPVVQEKLQTELKHVSDQLNKLQTSQSLLQSFLAKGKAESTNI

SEQ ID NO: 7950 - protein, 94 aa, Acinetobacter baumannii
SAYYKIRASLPAGRFCNGAIVPNRCPKEVTMAKLKTRRGAAKRFKATANGFKRKQAFKRHILTKKSAKRIRQLRGCVMVHVSDVASVRRMCPYI

SEQ ID NO: 7951 - protein, 419 aa, Acinetobacter baumannii
IRHYLKNKDNLMAVKKAQMMPTFAYEGVDRKGVKIKGELPAKSMALAKVTLRKQGVTVRNIREKRKNILEGLFKKKVTTLDITIFTRQLATMMKAGVPLVQGFEIVAEGLENPAMREVVLGIKGEVEGGSTFASALRKYPQHFDNLFCSLVESGEQSGALETMLDRVAIYKEKSELLKQKIKKAMKYPATVIVVAIVVTIILMVKVVPVFQDLFASFGADLPAFTQMVVNMSKWMQEYWFIMIIAIGAVIAAFLEAKKRSKKFRDGLDKLVLKLPIFGDLVYKAIIARYSRTLATTFAAGVPLIDALESTAGATNNVIYEKAVMKIREDVATGQQLQFAMRVSNRFPSMAIQMVAIGEESGALDSMLDKVATYYENEVDNAVDGLTSMMEPLIMAILGVLVGGLVIAMYLPIFQMGSVV

SEQ ID NO: 7952 - protein, 218 aa, Acinetobacter baumannii
PEVLMLQVKIVPVTAFAQNCSLVWDSETKEAVLIDAGGDAAVLKKEVEALGLKVKALWLTHGHLDHAGAVGELAQEWSVPVVGPHKEDQFWLDMIQEVSARYGFPIPQPVKVDQWLEGGEVLKLGEDEFEVRFAPGHTPGHVMFYNKNHGLLWTGDVLFKGSIGRTDFPRGNHEQLIESIQRECFSLPDETQFISGHGPMSTIGYEKQFNPFVAGKAG

SEQ ID NO: 7953 - protein, 96 aa, Acinetobacter baumannii
LRGYFTMGVFQLNTADYLFMKYRSMTVELMSVVQDYYPHLSKAEALRKANHQEFPFSVFKIDSSKRAPFLVHIKDLADILDKKYSEASKDFATFHQ

SEQ ID NO: 7954 - protein, 106 aa, Acinetobacter baumannii
HALYCKYLFFKGKVMLYVIPFIILLVVAVILKKRENSQKQEATSPKNINRKSGKKTSAKSSKSSREKTKTKVIEENTPAIPQSNPVPEALRHNIPTAHSRKTVFSS

SEQ ID NO: 7955 - protein, 548 aa, Acinetobacter baumannii
ERLYLFSYFIFCFNCHEGSGLAFLLAYKLKESERHRISLKLAFAVMMTLSIMGMHYTALISTNITDKFVSQYQAEHDLLLFTIILVTCLVLVASFIVAVLEQRLNQRNLELRKANKELANLSIQDNLTKLPNRLYLVDYAEVLLSDHRYKDQKIAFLYIDLDRFKSVNDAFGHHIGDQLLIQMANRLHWQLNEKCKLLRIGGDEFLLIAENTDTEEAMQLAEKVLHLIQDSYQISGKEINISASLGIALFPEHGQNVQDLLMNADAAMLMSKEQGRNTYTVFSYSTHQQETRSQSKLINDLYKAVEEKQFVLYYQPKFNTNLEICGVEALIRWNHPSLGMLTPHMFIGGAEKTGLIIPMGYWALEQACQQIQEWERSNTQFYPIAVNLSALQFENKKLFSTLEGLLKKYQIQPHHLIIEITESTAMRHIDLSIRACERLRDMGIRVAIDDFGTGHSSFLYLKDLPVDELKIDRGFIVDLKPGSKEEVILESIIHLAKKLGLTVTAEGVETQQQVEILTRLGCQQFQGYLLGMPVNVGQLIQSQGAHFV

SEQ ID NO: 7956 - protein, 243 aa, Acinetobacter baumannii
SAVYPLFQGNDMNMIKNSTNSTKKIPPLYWLLTVVMMAVLIAGGILFNQHQKRQTELQLAQLALEQSKVQNQSATTQAASEPVESGFTGIESMVENPESESTHSQAEDEVVAGAIAAVDQAKAQDTSLGNLSSEVDAEYHEGKTLSSNTSRYGLKPIKSAPADLKSTIPNIDQMLASHLMNVWGRSSPDQVSKRVEGWSQQGNTMTYRTAWDSDRYQCTWYVVSWDKNSNQVLHEGYQPCFGH

SEQ ID NO: 7957 - protein, 462 aa, Acinetobacter baumannii
SDDFFIIHRVFYGCSARARVHLFRARNMDFYKEKLSRKWGGLSIAVACFSLTYGHAYAQPLTLDTALNLAEQYAPTLRANSAQIEGAENVVSASGILPNPKLFVGLDNYPVSGDAAWSVTREGMTMQKIGVMQDFPNRAKRQAEVDLAKAELGSANAQTEILRIELRQKVASAWLKRFYLERKLALYDELFSENRLLSQITQTQVISGRTIIADALDPRQEATVLLDQKDDLLRDLNKAKLELHRLVSAEPTENLSQIETLPDQAPSIYLDRSKLYHHLHQHPELKAFQAEKQTAEAKLKQAQALQKPDWGIELAYQHRAPEFGDMIGVQLTTELPVFSKRRSSPLIRAALAEQNRITADQEVQYRDHLTMLDDGLSDLDALDQQIRRAMQTSIPLAKQKVGLQLASYQAGKSNLSNVIAARQALLEQRLRLIDLQQQQAVTKAQLYYAFEEPTLNHVEGQP

SEQ ID NO: 7958 - protein, 151 aa, Acinetobacter baumannii
RRLYPEVFKMAKKIDGYIKLQVPAGKANPSPPIGPALGQRGVNIMAFCKEFNAATQKVEPGLPIPVVITVYNDKSFTFIMKTPPASILLKKAAGIQKGSSVPNKTKVGKLTRAQLEEIATTKEPDLTGADLDARVRTIAGSARSMGLEVEL

SEQ ID NO: 7959 - protein, 497 aa, Acinetobacter baumannii
LVSYSASYLPRMQQNLTLLQHYHENKENCMSFSMTKLSAALLLTSSLVGCAAVVKTPYQAPAVQVPGSFQYDKAKAKTASVEQYSDRWWTLFGDAQLNQLVTNVLERNSDLAVAGITLQQARLQADLTANKQGLRTSSSVSTGHSFDLNSGDDSAKGLSMSAGVSYELDLFGKLARQTEASKWEALATEQDLQATGQSLIATTAKLYWQLGYLNERYATAQQSLATSQKLYQLVHTQYKAGAVSGLDLTQAEQSVQSQKASLSQIEQQLVETRTAIAVLLHEPVQQLNIQEPQRLPRTALPAIGAGLPADILSRRPDLQAAELRLRKALATKDATKASYYPSISLTSSLGSSSTSLTELLRNPALTLGASLSLPFLQYNDMKKDIAISNLDYEKAIIQYRQTLYQAFADVENALSSRTELDKQVALQERNVELAEKTERLTEVRYRYGAVALKTLLDAQQTTRTARLSLVETKQSQYNAYVTLMQALGGSPVKELPQ

SEQ ID NO: 7960 - protein, 153 aa, Acinetobacter baumannii
SLNLKIKEPLMAIERTLSIVKPDAVSKNHIGEIFARFEKAGLKIVATKMKHLSQADAEGFYAEHKERGFFGDLVAFMTSGPVVVSVLEGENAVLAHREILGATNPKEAAPGTIRADFAVSIDENAAHGSDSVASAEREIAYFFADNEICPRTR

SEQ ID NO: 7961 - protein, 89 aa, Acinetobacter baumannii
ISNLDINFFTLFSMHYYIFMIKKDYQFGLLFYLINRIDNLSYILIKADNKYRHRYLHHLLYHLRQMNIDQKDGRLFQVRHIGYHFSSCL

SEQ ID NO: 7962 - protein, 613 aa, Acinetobacter baumannii
RLFQMNSKNIALIGNPNCGKTSLFNTLTGTRQKVANYAGVTVERKEGFFKLPSGESVRVLDLPGTYSLKPTSLDEEVTRAVCLGELEGEVLPDIYVCVVDATNLHLHLSLVLEIRALNRPMLLVLNMMDEVKKRGISIDINKLSELLGIPVIEAVAVKTKGVQELLNQLDQKNLFVTPYHSDLNHFDQIKNITKQVILKNDNGDARTAFLDKIFLHPVLGLVILTLTMFVMFQAVFIWAQPFISLIENAIAWLGDTIGPLITHPLLRSLIVDGVIAGSGSVLAYMPQILILFFFILILEESGYLPRAAFLLDKLMSKAGLSGRSFIPLLSSFACAIPGVMATRSISSERDRLATIMIAPLMTCSARLPVYALLIAAFIPNKLVYGWLSLQGLVLFGLYMAGIVSALCVSLFLKLVRKDKTESIFIFELPTYRLPDIRNVALGLYDRATIFLKRVGGIIVALSILLWVLVTFPQPPEHATMPAINYSLAGQLGHIIQPIFAPIGFTWEICIALIPAMAAREVVIAALGVIYAMSGDEDTVTQTLLSQISGPDGWGLATGMSLLVWYIFAPHCLATLATIRRETSSWKQPVIMATYLFGLAYFFAFITYQLISRL

SEQ ID NO: 7963 - protein, 459 aa, Acinetobacter baumannii
KMTHKLFNAISFRIALIFSLSTIIILMIMGLVIHQLVMHHFETQDRTQLEGKIQLLENLLEQNPKNTEELKIYLKDALVGHHDLIVQIERPTGQIIFSSAPAVIKPQTLVKSKHTPWIEWKIQSKTYRGLVYKKSFDKNMSIPTAQIIVGIDTSEHQHFLNDFRRQLLYIGVVGTICLMFLGWFAAWRGLRPVQKMAKVAEGISAQHLSERLAVDNTPTELKSLAIAFNDMLDRLETAVEKLSDFSSDLAHEIRTPINNLMTQTQVCLSRSRDINTYQEVLFSNLEEFERLARMVSDMLFLAKAEHGLHLPNLQQVNLVQEISALFDFYDAIAAEKGMFLEQSGQGYVKGDPSMLRRALSNLLSNAIKYGKPDSVIKINCQQNIDTTIFTIENESSPITPEQLNRLFDRFYRTDASRQRVEEGTGLGLAITKSILDVHGAMIQADYSNSRIVFKITFKN

SEQ ID NO: 7964 - protein, 425 aa, Acinetobacter baumannii
ANYQHTIFQMQKHDAFAALRYRDFSIVTINQFCLTLAILIQEIIVAYSLYQITKDPLTLGLIGLAEAIPFIALSLWGGYFADKFNKQVIMKICLFFSVPLPLVLWLLFHLHGLGHISVNFLSWGIYAVIFGLGTIRGFYNPSATSLKPFLIPRELYANGATWTTIGWQSGVIIGPMLGGFMLAYLGRETSLFSVAGLLSICFILINLLHKRSFPKIETANVIESLGDGFRFIWKTKIVLWAISLDLASVLFGGVIALLPIFAEDILKVGPEGLGYLRAAPSIGALITMIALTRFPPTQHAWRNMLLAVAGFGVFTILFAFSNNMWLSLFALAMTGACDSISVVVRQTILQIFPPENMRGRVAAVNGMFVSSSNELGAFESGLAAKYLGTIAATIFGGCMTLAVVTFCWLKTNDLFKVDITKSSED

SEQ ID NO: 7965 - protein, 383 aa, Acinetobacter baumannii
KTNHLKRVISMIYIEVLAVVVIWLSFWSLIPRDEWWFRGADFPRLQILFIGLIALIGMLFWPTEWDVWRELLLAVLIAAIAYQLKMVLPYTLFWKKQVKKVKQHQLDPKKQISLIVSNVLTPNDKYHLLLEHVRTLKPDLLLTLESDTTWENALKEIEKDYPYRVPVPLDNLYGMHLYSRLPLKNTEVKFILSNEIPSIHTTVILRSGMPVQLYCLHPKPPSPTEAKDSTLRDAELLIVGDQIKDLDESCIVMGDLNDVAWSRTTRLFQRISGLLDPRVGRHFINTFHADYPLLRWSLDHIFHSTDFGLVKMQRLSHIGSDHFPVYVVLQTGRIFEEIHEELEQTQADEEEAQAAIQRGIAKAEKEEKIVTDEIAQPYKEKNI

SEQ ID NO: 7966 - protein, 212 aa, Acinetobacter baumannii
TRNHDKQGAIRMSLKLYTNNESRGVVIDWLLVELGVECERIEVAYRTEMKSPEYLKLNPFGKVPVLVDGDVVIYELGAICAYLADKFSDKGLAPALDDPKRGLYYRWLFMMAGPWEAAGVDKALGIEIAPEQKMFVGYGDYNDAYQALVQGLSEANPYVCGEQFTAADVSVGAMLLWQLKMKTIESHPAITRYVETIKQREGLKQSSMGQLL

SEQ ID NO: 7967 - protein, 1211 aa, Acinetobacter baumannii
MGIHVIQSQRIDVLLQGVLASTSQPSTHPLQVLKAQHFIVPSPAIEQWLIQKLAEQQGMSANYQFHQRVRGFQWYAYQQVLTAHKEQVRKANIPRLIFKWRVHQALQEFIQPDVMSIDSSHPLHSIVQRIYDSADRLEQGIEKQLKKQKMLYWVAEQVADLFSNYMVYRGQCQRGCENTCTCPNNWLAAWGQGRSLDIEKYIAHKDKEISAFTLQQTQELERWQRWLWQQHFHDDFMQMQQIDELFWQELEHPERQKKALSRLPEQIVIFTLLDLPPSQLQFLRRLGQYIDVLILHYNPSQEYWADSVDPLWKQRYDLGVKERFIAKNPQATDAEIADFFNKFTLNFNAEARESRHPLLTRLGKQARDHFSLLSNLSTGEEGKWVDAFVDDFPESLLGKVQSDILHLVEPQAKQYELAPNDDSIQIHVCHSTLRQLEVLKEQLIGWLAKPHEQPRRPNDILVLVPNLAEVEPLIRSVFPATATEQGVHLPVKIAGIASLDALNAWRAVIGRIHLMQGRFSFDEFADWLGLHATQQRYALEYAQVERILTLLADAGFKRGLDAEHLKRSLCDGDDDYRYSFKFALERLALGIAIPEHATFNQVLSYAKVQPGDFELIGTLIQIYQDLNERRDWLIMHEQKKSHTVEYWLQILSQDIVEFEQAGVAALKTAREIVKKQERMLTLASYYAETETGTLRKITLPLPYILDEIQRTLENQTAQAEPTGQITFAQIGQIRPLPYRLIVMLNLDAGQFPNRDTHVPFDLMDALRQQLGDRSRLEDDQGAFLDALLLAQENLWLFYNGFDVNDGEVRDPSSILQEFREHLALIVKPEPNAPDREVIEGIEIPTQLKQLYHLHYLQPFDPKGFMAENRYIRYQDHWFNVAMQIQQASGVLKPWANISYPLEIPDMLVLDSHQWIQDVTFPARLYLKTLGVENLGNVSVLDQNEPLLLDGLGRYTIRHFLQQNEQQAQPEVLLDQLPVGKVQYSAWQQGIFEQECLLERLHHYAPAVTQTTQRVWRIAKQLHMNITVPKSETQDWVSMEASSARAKRRAKVWLEYLLWLAYLNEGSAGTERRRIVVFSDQTVICKGISSEQARQYLQPWFKIWRYAQQQPLVLPAALLLKPLEKAKAYQWETTNPTEKIKLDEKSYAELLKYWNETGSFTAIDMTQNEACKLHQDWRFILQEQDAQALLQHACDEFAYDLYHPVFQFQHSE

SEQ ID NO: 7968 - protein, 161 aa, Acinetobacter baumannii
HRIHIKEKTMSEEQQVQPQLALERIYTKDISFEVPGAQVFTKQWQPELNINLSSAAEKIDPTHFEVSLKVVVQANNDNETAFIVDVTQSGIFLIDNIEEDRLPYILGAYCPNILFPFLREAVNDLVTKGSFPQLLLTPINFDAEFEANMQRAQAAAVEGQA

SEQ ID NO: 7969 - protein, 61 aa, Acinetobacter baumannii
LTCLERIKYYSKNLTGWMKPSKRHISVLHQPAKGWVNITDRRAFLGFHMNVRSCQIQNFIA

SEQ ID NO: 7970 - protein, 622 aa, Acinetobacter baumannii
RLSQLARSWFKTILAQTIKGTIAYLRLWIKTLTAAPDDLTLRLPPLSIEESYMEHIERESMEFDVVIVGAGPAGLSAAIKIRQLAIENNLPDLSVCVVEKGSEVGAHILSGAVLEPRAINELFPNWKEEGAPLNVPVTEDKTFFLLSETTSKEAPHWMVPKTMHNDGNYVISLGNVVRWLGQKAEELEVSIFPGFAASEVLYHEDGTVKGIQTGDMGIGKDGEPTHNFTPGYELHAKYTLFAEGCRGHLGKRLIAKYNLDKDADPQHYGIGIKELWEIDPAKHKPGLVMHGAGWPLSETGSSGGWWLYHAENNQVTLGMIVDLSYENPHMYPFMEMQRWKTHPLIKQYLEGGKRISYGARAVVKGGFNSLPKLTFPGGCLIGDDAGFLNFAKIKGSHTAMKSGMLCGEAVFEAIAAGVEKGGDLAVARVTEGEDLFVKELTSYTDKFNNSWLKEELYNARNFGPAMHKFGQWIGGAFNFIDQNVFKVPFTLHDLKQDFAVLKTVDATSFKPTYPKPDGKLTFDRLSSVFISNTVHEENQPAHLKLTDPSIPVNVNLPKWDEPAQRYCPAGVYEIMENDDGSKRFQINAANCVHCKTCDIKDPSQNITWVTPEGGGGPNYPNM

SEQ ID NO: 7971 - protein, 288 aa, Acinetobacter baumannii
KDSHAMKRILIVTGQSGSGKSSALQVLEDLGYYCIDNLPLALLPEIVAKLDHENNLEQLALGVDVRSTRADMQEFDHVFEQLQKHGTVDVIYLTTQDQDLIARFSASRRPHPLANRFKSLLQCIHEEKQLLIPIQFRATVHIDTTDKSVHDLKHILLSKLGQSDNLIVILQSFGYKHGIPLDADYVFDVRHLPNPHWDLELRRFSGLDEPVKQFLEASPQANEMFEDILHFLKKWLPAFAEGHRHYMTISIGCTGGQHRSVYMVDRLKQALEAEWSVQVLHREMKHWS

SEQ ID NO: 7972 - protein, 138 aa, Acinetobacter baumannii
SILHTIQYPFGVILMALTNEEILNAVAADTVLELVELISAFEEKFNVSAAAVAVAAPAGGAAAAAAEEQSEFNVELTSFGANKVAVIKAVREATGLGLKEAKDLVEGAPQVLKEGVSKEEGEELKKKLEEAGATVTLK

SEQ ID NO: 7973 - protein, 946 aa, Acinetobacter baumannii
YALQRDQSDVAMSNFNKTLSKRLRLNHAYGQLIALIFVPIMILTCVGAFLVLTETSRSAKQQQLHHASAILARYNQIAKDLYTLVELQPDEYDHAQHIMQSMFSEKNLKRAALIDSNGQTYLSIGYRDNRYWPNFTQKNNFFGPISYNHNNIYGVRIIDTVGKPPVWLLIEMDNQPLELARYRILIALVITGLMTLLLLLLCLNFYSRRWIAPMYEIRMQLQRLNADTLDQHIVINSSGELRLLQRDIANVVKRLHFSFLELKEHTEQTEEDLRRTLDTLEVQNITYRQARDQAISSNQAKSVFLANISHELRTPLNSIDGFIHLLLRQQNLSNEQNLYLQTIRKSSAHLLALINDVLDFSKIDAGKLELETAPFDLEEAVFDVMDMLSPLAAQKHIAMAFYYADNIPQQVIGDALRFKQILTNLISNAIKFTPDGEIIVRVRMEHDDIGQCLLHFSVQDSGIGLSGTDRKKLFESFSQGDASVTRQFGGTGLGLAISKQLVHLMHGQIGFEDNQERAPTEKGSTFWFTAQFAVDEEHEIEHPHFEHLQVVSYLAHPATASVLRYYLENYQVPHIETQSILDLFSRLKHLDQKDNTWLIVDHSGDTEALLKEIRSRYQGNLAVYGYQMTLEPNMLTEYRARPLYQPLSRSGLIQLLSDQPIFEEEQQDFNGQGLHILAVDDHLPNLIVLEALLGELNVKTTKALSGQEALNIIQERIDQKLKPFDLVFMDIQMPVMSGIDTTRAIRSLESTLDGEMQLPIIALTAHALADEKQKLLKVGMNDYVTKPIQMEQIIQILTQWTKNNFTAQNLAKDHHVVAEALDPEILNWQQSLQLAANKEDLAQDLLKMLVDSFPTELEEMQQLIELEDFPQLEHVLHRLYGATRYVGTPKLQQVTGDFEQFISTLRKERRRADDGFIEEVMRRFDELGLVIKEVESAAHQILVIPD

SEQ ID NO: 7974 - protein, 425 aa, Acinetobacter baumannii
CITQLMPFDQEVRKTIFISGLGYFNVATSVLVINCGSSSIKYALVSERREDRIYGLAENLGAADARIKGITVGGEPLELSIPYADHAKALETLLARLANYKPQAIGHRVVHGGSLTKAELLTPEIVERIRAATPLAPLHNPAHLIGIEATMRLFPELPQVAVFDTAFHQTMPAHAYRYAIPKFLYTEHNVRRYGFHGTSHAYVSDRGSELAGKFQKGGWLTAHLGNGSSTCAVWNGQSVDTSMGLTPLEGVVMGTRSGDVDPSLHSFLAKNLGWDLAKIDKVLNNESGLLGLSQLSNDMRTVIEAAENGNEDACLAIEVFSYRLAKSLAALSCGLPSIDGLIFTGGIGENSAYIREKTLAYLPHFGLQLDKDQNNNLKRGIEGRIDSGTGPQIWVIPTDEEGRIAKETRQVVEVSQNTSPEVSLA

SEQ ID NO: 7975 - protein, 342 aa, Acinetobacter baumannii
RRTQMQIFYDKDCDLSIIQSKKVAIIGYGSQGHAHALNLKDSGVDVTVGLRAGSASWKKAENAGLKVAEVPAAVKQADLVMILTPDEFQSQLYRDVIEPNIKEGATLAFAHGFSVLYNQVVPRKDLDVIMVAPKAPGHTVRSEFQRGSGVPDLIAIHQDASGNARNVALSYASGVGGGRTGIIETSFREETETDLFGEQAVLCGGAVELVKMGFETLVEAGYAPEMAYFECLHELKLIVDLMFEGGIADMNYSVSNNAEYGEYVTGPEVINEQSREAMRNALKRIQSGEYAKMFIQEGALNYPSMTARRRQNAAHGIEQTGAKLRAMMPWIQANKIVDKEKN

SEQ ID NO: 7976 - protein, 74 aa, Acinetobacter baumannii
QIKQIGAAMGLRWTDTIDIAIELSEAHPEVDPQWIRFTDLHAWVCALPDFSDDPNKSTEGLLEAIQMAWLDEVR

SEQ ID NO: 7977 - protein, 184 aa, Acinetobacter baumannii
VTKQYMTHRCLIAPPEMADDFFANTVIYLARHDEEGAQGIIINRPAGIQIKELLNDLDIDADNVNPHEVLQGGPLRPEAGFVLHTGQPTWHSSIAVGENVCITTSKDILDAIAHNEGVGRYQIALGYASWGKNQLEDEIARGDWLICDADMDLIFNLPYDDRWDAAYKKIGVDRTWLASEIGHA

SEQ ID NO: 7978 - protein, 61 aa, Acinetobacter baumannii
IKEQNKGTQRSGDQRSQLTTKLNLNTTPEFDVTVLFYEPYTPKANKPQEQKPKRQLAFLGK

SEQ ID NO: 7979 - protein, 366 aa, Acinetobacter baumannii
FIRQTVLSIFLSLDKLYVIKMFNKVCIMLKNKFMILAILPFMLSACGGGGASDSNSANNNQSSTSQDTIADGTRYYFMDYNPDQIDELDEKIDELNIAYFEIFNKKSTDSSSNQVLGEYLLTEKKLYSPTDKAINVMNFNSLTDWRLDLIGDVKEDWKFQRVDLSNKNMFDTVLPGYRAVGFPVVDKSTAKGRLFLNTYGQNKFPEGSSCYRLISKKSNQETFVFNVDQNHEINQSFEDFDAENGPYLNYLNQTNPFGFTYKAVKGTWQNIPWTTIYDTSLGFAENDGVAVQYQGKTYAADYTSNIGWTAEQEIKHWEIYLKNIDNPERMRVAQLRIAQLKSGCYSYNETAANALAALSALDWKPY

SEQ ID NO: 7980 - protein, 493 aa, Acinetobacter baumannii
RRRQRLLQTLRASKCGLSTAQLPSSILDVIDSLTKAGYEAYIVGGGVRDLMLGLNPKDFDAVTNATPSQIKEVFGRRCRIIGRRFELAHVYSGRELIEVATFRAPPKKAVTSASGMILRDNNWGTIEQDFARRDFSINTLYYQPRKGIVLDFCKAIDDVKSKTLRLLGDPVQRFEEDPVRMLRTLRFAAKLNFKIDPAILDIFDVEMTQLLRDVSPHRLYDESQKLFTMGHLARVLPMLIDFGVWKQLFADIRPDLTPFIQRAAKNTDQRIQVGKTINPAFFYAVLLWQPFLERCDFYLSKGVVPAEARAQAGLDVLKRQATRTVIPRFAETFIREVWEMQTRLLNPKPQQIEALASHARFRAGFDFLLLREKSGDDTTQGMGSWWEAYQEMSNDEKETAISQYNRQKAKSRRKVAAEPVESNKVDTEIEPLVDVPEPRSRRGKKERARQEHSYDRVIEKSSAAQTNVMSDHPILKRKRVQRDLSQVIFGPTQ

SEQ ID NO: 7981 - protein, 61 aa, Acinetobacter baumannii
AYLQTTKLTISWSIDENELLVCPAYSSKTSSRTPDAAPRARINFCLYFRSDLFKFPLIFLY

SEQ ID NO: 7982 - protein, 63 aa, Acinetobacter baumannii
MNLHDGVLSIRLAFWDELSVGVTFLSGKVTKTIVIRKTCSLSASIKYIEAINILQQMSRLRMT

SEQ ID NO: 7983 - protein, 498 aa, Acinetobacter baumannii
IVMQILKQIQVPYSFAKRHGVLFRYDGDQVFIVRRQNTEKIALQEARRILGKPAHYQLCTEQEFNSLLSTSYAGDTGESQQVAAGLEDHPDLLSLADQVPETEDLMDQEDDAPIVRLINALLSEAIRVGASDIHIEAFEKKLSVRLRVDGQLREIVQPRRELAPLLVSRIKVMAKLDIAEKRVPQDGRISLRLAGREVDVRVSTLPSSHGERVVMRLLDKQAGRLNMTHLGLMANDYERLTQLVHRPHGIILVTGPTGSGKTTTLYAALSDLNDNTRNILTAEDPIEYQLEGIGQTQVNTKVDMTFARALKAMLRQDPDVVMVGEIRDLETAEIAVQASLTGHLVLSTLHTNTAIGAVTRLKDMGIEPFLLSSSLIGVVAQRLVRTLCPHCMTWREADTFEKQVFQHISHEPSLKLPEAQGCDQCSHLGFNGRTAIYEIVPIDEPMRRLIHGNAAEFELENHARQYSGSIRDDGLRKVLSGKTTLEEVLRVTNEASEA

SEQ ID NO: 7984 - protein, 168 aa, Acinetobacter baumannii
RGAHLMRHIISVLVENEAGALSRLVGLFSQRNYNIETLNVAPTEDPTLSRLTLTTYGDDHKIEQITKQLNKLVEVVKVVDLSEGSHIERELMLIKVKALGASRAEIKRTADIFRAQIVDVTPTTYTIQIAGTTEKLDGFIDALAENTILEVVRSGVSGIARGEKVLAI

SEQ ID NO: 7985 - protein, 100 aa, Acinetobacter baumannii
CEKQIGGQRMTILPYALGISLIAITISMLLCLFRMVMGPSIVDRLLALDTLFLNATCLIIVLGIYWTTTSLFEGALLVAMLGFVSTAALARYFTTGHVID

SEQ ID NO: 7986 - protein, 168 aa, Acinetobacter baumannii
SWEQVMNFLKQSAFIAVFAFMGLPTVQAEEVATLPTIRVMAESELREEVGFVPFQEDKKVRQALQHREYKIHNDIQNALVPEGMTTVDYQPVMAQPDLSQLSPFLREYILAVAGGIQSSDPTNGLFEMLKPLNINRTNVDAYREGTMKVNLDDILRLQQQIQDGLKGR

SEQ ID NO: 7987 - protein, 344 aa, Acinetobacter baumannii
TERHLHMSFEQKPKVTVILANLGTPDEATVPAVRRFLKQFLSDPRVIEIPKFIWRIILNLFVLPFRPKRVAHAYASVWSTDSPMREIVFEQTQRVQAYLERENKQFDLTVLPAMTYGNPGIDAVLEKLAAHPQEHVILLPLFPQYSATSTAPLYDAFAKWIPTQRNLPGLTIIKDYYQHPMFIQALAESVLAYQAQHGKPEKLLMSFHGIPQPYADKGDPYADRCRITAKLVAEALHLKDDEWAISFQSRFGKQEWVKPYTDQLLQDWAKQGVKSVQVLSPAFSADCLETLEELAIQNAELFQEAGGGSYAYIPALNSDQAHIDLLAGLVQANLDALTHTLAHR

SEQ ID NO: 7988 - protein, 209 aa, Acinetobacter baumannii
RTFKIDITGGKLMRIDQQLAEKWIKPGSSVLDLGCGDGELLAHMSQKHQIRAYGLEIDQEKIAIAVSRGLNIIQQDLNLGLSRFADQSFDYVVMAQALQAVDAPDVLLRDMVRVGKQAIITFPNFAHWKTRSFLALKGMMPVSDALPYMWYNTPNIHLCTFKDFEALCAENQIQIINRLAVNGNQQGSLLSKHVPNLFGEVAIYRVSAL

SEQ ID NO: 7989 - protein, 285 aa, Acinetobacter baumannii
SLFNNSVEEFYVLFENNEYQPHPQNSLKWWGEQHFEINQSKAWQFGSMLFRLTRGIKEWRIEYYRPTLQDDNEQDWHIITDANFGFPHSVQVERYMFRKTNPNFLLMPRLADRSVVIKPVDPIYIPAGQRGTLYISTPLWIAGLVESQHEPLFEIPVIQPKDTWFGPNAQQGEICYATSVDGRTDLNLLTPRAFRAVTPIDFHNTSNHQLRFDRMNVPVTALPLFYSESTGRLWTSQIKVYYEGSDRPARIRIENRTPPLAGEVTYVHPPRSPGGALFNMFDSFF

SEQ ID NO: 7990 - protein, 154 aa, Acinetobacter baumannii
PQLKLRLDTHLNFIKRLSSMNKEIFKIINPSTLYDPTPNAYSHVAVVSNFNNIIHIAGQGGEDQQGQLSSHFSEQVLQAFENINYALVAANAELTDIAVLRILVVDHSVEKHEILIKIMKDLWKNYPFPACTLIPVPRLALKHMLIEVEATAYT

SEQ ID NO: 7991 - protein, 613 aa, Acinetobacter baumannii
MSFLLQATIFLGASLILVPLGKRLGIATVLGYLFTGILLGPSVLNIAHDPEAIMELAEFGVILLMFLIGLELRPQRLWEMRDSIFVMGSLQVVITGIILMLTVLLLFQQHLAASFVIGFALALSSTAFVLQLLTEKQQLNTTYGQQSFSILLFQDIAAIPLLAVIPLLAGTESTHHGIAYFAAIIATFTGLFLFSRYVMRPFFRFVAKSGATELITAVGLFIILAVVLLMDTLGISTTLGAFLTGVLLADSEFRHELEASIAPFKGLLLGLFFMTVGMTTQLSLLIEMPWLIIGGAIGLLVIKTLVLTAIARYKKYSWNNSLLLGTCLAQGGEFAFVILSLAKSEKILTDALLEPVTLIVTLSMVLTPVIYWIMACKIIPLFHKELPPEYDEIPQQDNPIIIAGFGRFGQIIARIARLQHLGFTAIDNNLHQVDFVRRYGGKLYYGDVTQPDLLRSAGIEKAKVFILAIDDVEDSMNVARHLRLNYPNLKLLARARDRHHVHLLRDLGVEHIWRETYLSSLGMAYRALRELGISDEQAYNNIEIFRDYDEKLLIQQQSIYTDEQKVFETHRNALAELEHLFESDAQQAISKHDVNLKRHLQPNRIDITRDHEE

SEQ ID NO: 7992 - protein, 66 aa, Acinetobacter baumannii
HFLLGIMLSRHCLNKGLQPEIYSLLKHSFFIFSMTGNRQSQHHKKSKAPKRYFRFLNHNYFRKTHN

SEQ ID NO: 7993 - protein, 299 aa, Acinetobacter baumannii
LNYKKNFLLRMIMSKKFEDFNNPREKALQGMKDSIPASQWEENLQFLKQLRNKIAQLPVSKHPAIEILNNGYLDKQTLTRIHLEYRHAIVQIFTDALLKAQFMTKQLEPKLHSGAKMFPRVLLSLNILDEFGFRPGLDKDNYYLGNPEYAHYPLYEDLLNDYGLTEADRRNYKPSKIADQVRTFLEASYDSYINVVALLAVAEEEVILFSPPLRQATKFVNIDVEGGGYYHVHGVSTDETAEAADDDHQDDLWFALAQAITKDDYESLTQLCLDYCALWTEFWDAQIADVQFIEEKKLA

SEQ ID NO: 7994 - protein, 588 aa, Acinetobacter baumannii
QKYNFSYTNYKHINIGRQMSALHTSPKFTGFFRRLVEEKHVSAATMQTALDAAKRAKQDTVAYLIEEVHLSPSLLAETISAEFAEPYFDLDVYDTSQIPKDLVDQKLILKHRILPLIQRGQILYVATSNPSNIEAIDAIRFNSKLLVEPVIVEHHKLEKVLGQHFAEESSFDFNDEEFDLDVNLDGPTAQEDEEEAPQGDEAPIVKYINKLLIDAIRMGASDLHFEPYEKSYRVRYRVDGVLRQIANPPLQLANRLASRLKVMSQMDISEKRVPQDGRIKLKLSKSKAIDFRVNSLPTLFGEKLVLRILDPSSAMLGIDALGYEEDQKALFMEALDKPQGMLLITGPTGSGKTVSLYTGLNILNTESSNISTAEDPVEINLEGINQVNVNPKVGLTFAAALKSFLRQDPDIIMVGEIRDLETAEIAIKAAQTGHMVMSTLHTNSAPETLTRLRNMGVPSFNIATSVNLVIAQRLARRLCSQCKIPADIPKQSLLEMGFTEQDLAHPDFRVFQPVGCSECREGYKGRVGIYEVMKVTPEISKIIMEDGNALEIAAASEKLGFNNLRRSGLKKVMQGVTSLQEVNRVTSE

SEQ ID NO: 7995 - protein, 272 aa, Acinetobacter baumannii
SNNKRSLCMGRLAVNLSMIFTEVPLIERFALAHAEGFEHVEIQFPYELAISDIQDQLERYNLNLCLINVPAGDLMQGGNGLAGIPGQEAAFREALQLAIRYATALKVPRVNILAGKQPQDSDLLPCLKTLASNLKLACDLLTEHDIEPVFEMINGTDMPRFLVQNIAQAQEMLEAVNHPALKMQYDCYHMAMMGEDVLEGLQENIHQIGHIQFADCPGRHEPDTAQIPYEQIFSWIKQSAYEGYIAAEYKPKNGSNQSFTWKKKYFSDDVNI

SEQ ID NO: 7996 - protein, 313 aa, Acinetobacter baumannii
NINNQYASSLLAYCYHWGENMIPEAWMYATWLIKVVLYLGIAFIVGGAFSYFLLGRYVEIKQAILKYITIGAGVGFISSALSFFVLIGSFSNTGFSGMWNSNYINILINTPTGHVHIIRSISFALLLLFMIVKLGKGTIQISKVEGTIFTILLIPIVFSFSQLGHVTNLPLFAQFLLSIHILVMSLWMGSLFPLWRTTKKITGIPLKDRMHLFGRIAAFVVGILLACGASIALLLIKDFNTLLNTPYGHGFIIKIVFVLSVLLLAAFNKWYFTPRLQDPKFAKQLGYAILFEMSLGLMILLTTGYITTVVGID

SEQ ID NO: 7997 - protein, 146 aa, Acinetobacter baumannii
AINNNRTYENMSQTSPVYQGSCLCQGIRYEIKGDIGDIIQCHCQRCRKANGTAFATNAPINSADFKITQGEDLVKKFAVNGVYRWFCSECGSPLISSRDAQPELYRLRIGTLDTPLDQKPTMHIFAASKAEWESICDDLPQYDERP

SEQ ID NO: 7998 - protein, 60 aa, Acinetobacter baumannii
IRNNERLPCGRNSIPQRSTPHASTAGAIMSYNAWDLFDNFIYSRHSRAIQSVVLTDTDLL

SEQ ID NO: 7999 - protein, 61 aa, Acinetobacter baumannii
FPNNSFNCCIDIYFLHVSTWWQSTLALCISRLIYIGALELNFKRSDSLILELDHFVTKTIN

SEQ ID NO: 8000 - protein, 148 aa, Acinetobacter baumannii
FRNKKMSLEKVVYRAKAKATGGRDGRATSSDGVLDVQLGVPKEMGGAGGAVTNPEQLFAAGYSACFLGALKFVANRDKFNISKDAYVEGEVGIGPIPTGFSIEVTLNVYLIGMDREEAEKLVAAAHIVCPYSNATRNNIDVTFNIVTE

SEQ ID NO: 8001 - protein, 241 aa, Acinetobacter baumannii
PNSKNIFKITARRVNKMVGLFQHLGRSVQNRPHFFIALIFGVVVASLLAWLTSWKWSTILLASWNGSISLYLLHVWKLMRSADHSQMQQQAKKQDESKWVIMLIVLLAITMSLVAILVQLSQLPSGHYEKLGHVALALLTIISAWLFMHTVFALHYAHDFYMALSRNEENGGLDFPGTEHPTYPDFLYFSYIIGTSAQTADVSITNKHMRLLNLFHAVLSFGFNTTILAICINVAAGFLTN

SEQ ID NO: 8002 - protein, 330 aa, Acinetobacter baumannii
EDSNMTKYASDALIAATHSSCSIQPIWAYDLIGSEKSAKALGGSKTTSMFAKQKSQNSNQALSLSKPVELIRSVYPLVTGSPVTNGMLSVRLKPENELFIQFIKQIGPMLNGGIYCNDQYFSYQIMGYQYTLITRQFNEKLMAWNAEQVRTEELFDLTMKALYKNYAGFEIHELYLPILFTLSTNATTYSKQQYLDQQKKEMIALFINEGGNNDVVAVFSKWELTPQGQLALRLVFLLERQFINDPVGWSDENAFTALHGNLESLFNCKAYPVSMPLNGFMQTNRFLKNDPKCKDLIKLLKTYLVGTDTILRIWDTQSSFDVLFSKFTTN

SEQ ID NO: 8003 - protein, 144 aa, Acinetobacter baumannii
IVSNCQENIPYMNLEPSPSVSNSHDFAMNTSNKDVQACLKVVHDALVDVKAKDILQLDVSSISNVADAIVIASGTSTRHVKALADNVAEEARKAGFRPIGVEGERDAEWILIDLGFVVVHVMLPTARKFYDLESLWRTAPESVA

SEQ ID NO: 8004 - protein, 80 aa, Acinetobacter baumannii
PLGKFKDDSVFRLKCLGGPLYGQEYSHAQDEFIFKDKQTGKQTRYRKQALNFTPPQEFFIAESISTTVAYNLALQLMKRY

SEQ ID NO: 8005 - protein, 359 aa, Acinetobacter baumannii
KKLNLTKLRFYSLYLHDDACKNRQNLSSCRTYSVSLEFESRRDNMSNENQKPTSPTEQAQSSDKVSPFLSSPLPQGTPQGQQQSLQQTLTDTPVSGSVPKYNLPRGAGNTGNVGETTHFGYSTVRTEDKAQKVAEVFHSVASKYDLMNDLMSFGIHRLWKRFAINMSGVRRGQHVLDIAGGTGDLAKVFSREVGPQGHVVLSDINESMLNVGRDRLIDAGCTNVDFVLANAETLEPFADNSFDLVTISFGLRNVTDKDAALASMFRVLKPGGRLLVLEFSKPVFEPFSKLYDLYSFTALPIMGKLVANDSESYKYLAESIRMHPDQRTLKGMMENAGFQNCDYHNLTGGIVAVHRGFKL

SEQ ID NO: 8006 - protein, 740 aa, Acinetobacter baumannii
NRLNKYTHKSYGFIMTTASNHPTRRDILKWFTGIPFLPLGAMATAATLAGCNDSDNDSSIVTPSKPINFKNATFTSMPAPSTVADIATTACASKLAISWEDGSKTEYQLAYKPFFLTGTEVPDGKGGKVIAGGYYDINNKPIIDKSVAGKERQFFSDCPDGSSLISFKQATGKDFTDADKKALGVTGNPVFHVVQFEYLSKDQNGGDTYGKLSSPIAVLTLDQDPKTGHLTLIKYHNVDTSSAHGLWITCGASLSPWGTHLSSEEYEPDAFDQKLGQSLSTLKAFSKNIYGDENIANPYNYGHLPEITVNADGTGRVTKHYCLGRISHELVQVFPDNRTVLMGDDYTNGGLFMFVADKEKDLSAGTLYVAKYTTVLSDTTTGQISWIRLGHATSAEIENLIKSGIKGTDIFESVLQIAKYPSDATTAEKEAIDAGDKGTPEQQALAKAAKERLKLQQAAQKAELEAQGFKFTYLSKTGVYLKLKDNSDRTKLAAAFLETHRYAAYMGASMALTKNEGTTVNIADKKAYSALANIVDSMVEGGSGYLAEHNVKFPKITAGGILEHTLTGGQKDSSNVAINSEWVPSQSNLLIKGKDISFDSLGNTADPEQIASPDNLKFSEKLRTLFIGEDSGNHLNNFLWAYNVDTKQLIRILSTPAGAESTGLHAVDEVNGWTYIMSNFQHPGDEWNRFYKEKDGVRTGISADLLAQIDTAINTNYSNKFAAAVGYITADPIAPSVVKK

SEQ ID NO: 8007 - protein, 138 aa, Acinetobacter baumannii
GKVKMQITMEIIVSIFLVFGAFFMLVGSIGMVRLPDLFMRLHAPTKSSTLGLGSFLIASMIFFAFQGRFGFAELLITLLAFITAPVSANLIAQAALHLRLRSLSGEVPEAIERPLPWDRYKIGQRFSQNKPPMEPPQE

SEQ ID NO: 8008 - protein, 65 aa, Acinetobacter baumannii
ASPNETDSAHQVREMLSFNLSHSLNKVLFIYYAKLLFKYIAYFLLYFNFLVTIKYGNNSYFKSQI

SEQ ID NO: 8009 - protein, 126 aa, Acinetobacter baumannii
LKPKGVSTVMNKKIGLISTVILSTVMFTGCQNMSPSDQRIGAAAGGALGGGLGNHVGGGIGAGLGAAVGAGVGSNTQGGSKQTTTKSAIGAGIGSVVGKAIIGGDTGAAIGGAIGGGAGAAIEEKK

SEQ ID NO: 8010 - protein, 404 aa, Acinetobacter baumannii
NCCFDSVTLAVVSTFDTLNSPFNNFNAPRQNDMKVGLVGWRGMVGSVLMQRMVEENDFAHIEPFYFSTSNAGGEAPSFGGKTAPALMEATDITSLKQMDVIITCQGGDYTSEVFPKLKATGWDGYWIDAASTLRMTDDAIIVLDPVNLNVIKDGLAKGTKTFVGGNCTVSLMLMGVGALFQNNLVEWMTAMTYQAASGAGAQNMRELLTGMGYLYNNTKTLLDDPKSAILDIDRQVAELQRGEGFPSANFGVPLAGSLIPYIDKQLESGQSKEEWKGQVETNKILGNSQIVPIDGHCVRIGAMRCHSQALTIKLKKDVPLDEIEDMIRNSNQWAKVVPNTREASMTDLTPVAVTGTLTVPVGRLRKLNMGKEYLGAFTVGDQLLWGAAEPLRRMLRILVEYKSS

SEQ ID NO: 8011 - protein, 95 aa, Acinetobacter baumannii
KQTKSLRRIVMAANVIVYSTSVCPYCVRAKQLLERKGVAYKEVNLSVEAPEVRAELMQRTNHRTVPQIFINDQFIGGFDQLYALEREGKLDELLA

SEQ ID NO: 8012 - protein, 74 aa, Acinetobacter baumannii
AMANKEELIEFEGVVTETLPNTMFRVRLENGHEVIAHISGKMRKHYIRILTGDSVKVEMTPYDLTKGRITYRAR

SEQ ID NO: 8013 - protein, 292 aa, Acinetobacter baumannii
RSHKNNKSSSGRMTQHLSKHRHISFTAHYTGYIWYQMGISHEALATSKGKSLAYLVHPLESWAEKYVGGSMRTTLKQRHTMLDHDLEKLIQENSDLQVLEIACGLSPRGWWFRQHYPSISYRELDLPDMAQTKQNALQQIEKNAPEVLSVDLFTEAFAQAFEVFDSNRPLVVISEGLINYFDKDLLKQLIQSIAHYGASFKKLHYLTDLYPEPVKNKLASIIWNSSKLLKLMSRSSFSFHFKTPLEVKDFFKDAGFSQVNVEQPQIFFGQVSKDNDEEHLGDLVWTIHVQLK

SEQ ID NO: 8014 - protein, 696 aa, Acinetobacter baumannii
ITNKRALRVLFFVFSERRSISWHGSVKLSLGVLAICVMSLAKLINELNAQQKKAATTTAQNCLVLAGAGCGKTKTIVARAAYLIDQGLPANQIQILTFTRRAASEIVARVEQHVGAQAKGLRASTFHTFCMYLLRRNPQAFGLTQFSIIDRDDQLLMFRLLRGKDKDNVLPKAAELCDLYSYARNTQSKLSEALLKQLPEAYEYKSQIAELMKTYEQRKRERNFLDYDDILSIVAVHLQNSEVLTNWVAGFCQALLVDEMQDTNPLQWALLQPLIGKVKLFCVGDDAQSIYGFRGADFENIHSFKERIPDAVIHTLDLNYRSTQEILDLSNWLLAHSPIDYQKQLQAHRGKGQKPQLHLFGNEFEEANWIAQDLIERHQQGANWYDHMVLVRSGYSARYLEGAFIAAEIPYRFIGGVKLLESAHVKDVLSLLRIVSNPQDDLAWMRFLTLWDGIGDVGASKLAQELMSISEVEERCHRLERHGKVPLQAILILKQLDVLQQHVEASIGLALDALSEQLEQNYKTKDWSRRARDFDLVKQLARKHASLGEFLEEYVLEPISISEIEKAGDDDLVTLITIHSAKGAEQKVCYVPHVSPNQYPYARAQGDFDEVEEERRVLYVALTRAENELILTKQNLNTWSQDTYDEQGRKIESYFLNDLPAHLVQVKIHRQVPQPFAKKQWNTSRTVNLGFGIDLD

SEQ ID NO: 8015 - protein, 312 aa, Acinetobacter baumannii
RCLNAGNCMIKWIILAIFVISALYIQHRGKVRHSFYRQFFDHSTLLAPINFLMYIFSKVPNQPYIDTQHFKDLKVLDENWEMIRDEAKALYDQGGIKASSTYNDLGFNSFFKTGWKRFYLKWYESSHPSAAELCPKTTALLKTLPTIKAAMFTELAPDSRLVRHRDPYAGSLRYHLGLITPNDDRCFIDVDGERYSWRDGQSVVFDETYIHYAENKTDQNRIIFFADVERPMKVKWMERFNHWFGRNVMTAASSPNETGDQTGGLNKAFGYVYQIRIKAKALKAKNRKLYYFLKWFLMLGIFFLIFVRPYVF

SEQ ID NO: 8016 - protein, 139 aa, Acinetobacter baumannii
KSLNFGLIFMQWLKTCLSLFLSFAILLVGSAAAASSVHKRCLMPSEQISMQMEMSSNQGMMHTDCMKTEVKIKKDIHDPSCMSEQDCIMSFAKIAYANIAQDISHSIVFSPIERSIFYSPDQDLPSPYPSGLWKPPRSN

SEQ ID NO: 8017 - protein, 128 aa, Acinetobacter baumannii
AQLNYIHHNLYKCGIIWRVCMSSTQFDHVTVIKKSNVYFGGACISHTVQFEDGTKKTLGVILPTEQPLTFETHVPERMEIISGECRVKIADSNESELFRAGQSFYVPGNSVFKIETDEVLDYVCHLEG

SEQ ID NO: 8018 - protein, 797 aa, Acinetobacter baumannii
GFIKMKISENWLRTWVNPAIDSDTLSDQLTMLGLEVDELAPVAKPFTGVVVGEVLTVEQHPDADRLRVTTVNIDSGEPLQIVCGAPNVRAGMKAPVATIGAILPGDFKIKKGKLRGVESQGMLCGASEIDLEDKIDGLLELPDDAPVGVNIREYLKLDDNVIDISITPNRGDCFSIRGIAREVAVINQLQMNEPEIKSVDATITDEKKVVINTDGAPRYLGRVIKNVNVKASTPEWMEQALARSGIRTHSILVDVTNYVLMELGQPMHAFDLAKIEGTVHVRQAKPQEKLQLLNDQEVELQEDVMVIADDQKALAIAGIMGGLASSVTDDTTDIFLESAFFAPLAIAGRARRFGLHTDSSQRYERGVDFELPLIAMNRASQLIQELAGGEFGPITVAEKSDLLPKREAIELKQAQVDQLLGYQVAAEFITDALTRLGCEVTVKADGEWSVVPPSHRYDMAIYQDLIEEVARIDGYDNIQISLPSMDVQLAKYQDRFEIAQLRQTVVTLGYQEAISFSFADAKLEKQLNPQVSPLMLANPISSDLAAMRSTLLSSLIPCVQYNLNRQQSRVRFFELGLRFDYQNANSIQDLKQIPTLALVAVGSREPESWHAKPQPMDFFDFKGEVEEILAAGRVKVEYVRSERPWLHPGQSAEILVDGQSIGYLGRLHPSLENELDLSTTWVAELDQAAVLQSYVSNFTELSRFPSVRRDIALLISDNINVRDIQQLIEKTGGELLDSTWLFDVYTGQGVEEGKRSLAFALLWQHPSRTLEDAEIKSGMDNIIQVLENTYQATLRAS

SEQ ID NO: 8019 - protein, 73 aa, Acinetobacter baumannii
TRINRVLPNQIQPITNHNGEIKANQWMFHCKFLIFLGKPIQPTALWQQVRSKDKLRFNVNTSSKVYVHIADQT

SEQ ID NO: 8020 - protein, 157 aa, Acinetobacter baumannii
ILIKMMKFSSQLFLILPLAMGIGVAMAFQTAINAQLREQLHSPLQAALLSFFIGTIVLAIMVFFQSAEKPSLSEISNIPWLLWTGGFLGVYAISMSIYTAPKLGFLTFTGLVVFGQLVISMLLDHFGWLGTEKTPVTWQRFLGGVVIFVGVLLTLQR

SEQ ID NO: 8021 - protein, 246 aa, Acinetobacter baumannii
FFVNSPILEPYMSKLAAFDELLQQYKTFNYHDNPVLAQRLQDVQTWLKERMKETHHDFFNLPEHKLMAQYFLNRLYGGPEFDALAAQIERLLKYAHKAEKVLPENAIKTGTKSVSLAVLATQLDEQVAMQLLEDYPADTVLTDEIMRLTLIKLDQAEARYQQLALLDDLGAALDKYMRSFMMFTAFKMCKGIAQKYHFELMYDFIQDGFSAMKPLKSAEAFIKTFTEKERQIVEKVHSGHPNPFRV

SEQ ID NO: 8022 - protein, 269 aa, Acinetobacter baumannii
KAVKYSPCFISPQRVAMTDLQQDEYDRRFAGVAKIYGDSSFQHYEQSHVMVIGIGGVGSWAVEALARTGIGEITLVDMDVVAASNVNRQLPAMTSTLGCEKVEIMAERCRQINPRIKVNIIDDFLTPENVAELLNPVPDIVLDCIDDVKAKLALMLHCRFNKIPLIVSGGAGGKLDPLKIRVADLSKTEQDPMLAKLRSQLRARGICKKPKEKFGITCIYSIDNPFSSADVCPSAGLRCGGYGSAVVVTSSFAMIAVAEVLKKLDLKKA

SEQ ID NO: 8023 - protein, 204 aa, Acinetobacter baumannii
TMVNQNNSPSDMGKIPLSDDKNLMNIAQYLKGVQQSHKRSIPPLEQWHPKHCGKMDLTVKANGEWWHEGQLIKRQALLDLFTKVLWKEEGKFYLKTPVEQIEIEVEDEPLLVNQVDQIEISGDEFLQLTTTNQDVILVDAEHPIFMREYAGELRPYVHVRFGINALIQRQAFYHLVNYGTLVENDKGETILQLKSGNLHLQLGT

SEQ ID NO: 8024 - protein, 526 aa, Acinetobacter baumannii
SLTNPIYIFWPILKHSGMIPKSFLIYKNDKLDLCKTLAIIEERLELPSPMEQDDMAGKTLYDKLWDDHVVTQRDDGSCLLYIDRHLLHEVTSPQAFEGLQLAGRQPWRLSANVATPDHNVPTSKKERDQGIAGIEDDTSRIQVQTLDDNCKAFNIVEFGINDIRQGIVHVVGPEQGLTLPGMTVVCGDSHTATHGAFGCLAHGIGTSEVEHVLATQCLVQKKSKNMLVRVDGVLGKGVTPKDVVLAIIGKIGTAGGTGYAIEFGGQVFRDMSIEGRMTVCNMAIEAGARVGMVAVDDKTIEYVKGRSYAPKGEQWEQAVAYWNTLHSDVDAVFDAVVELNGAEIEPQVSWGTSPEMVIPVSKAVPTLEQAKDDVQRNDWTRAYQYMGLNAGQALADIQLDRVFIGSCTNSRIEDIRAAAEVVKGRKVAPSIKQAMIVPGSGLVKQQAEKEGLDKIFLEAGFEWREPGCSMCLAMNADKLQPGEHCASTSNRNFEGRQGNGGRTHLVSPAMAAAAAIAGHFVDVRSF

SEQ ID NO: 8025 - protein, 232 aa, Acinetobacter baumannii
DMAKLTKRQKAIAAAVEANKVYTLEEAVQVLNSLPAAKFKESLDISVNLGVDPRKSDQVVRGATTLPAGTGKTVRVAVFAQGAQAEAAKEAGADVVGFDDLAESIQGGNLDFDVVIAAPDAMRVVGKLGTILGPRGLMPNPKVGTVTPDVAGAVKNAKSGQARYRVDKAGIIHAAIGQVGFDAAAIRQNVETLVADLKKLKPATSKGVYIKKITLSSTMGPGLTVDVNNVSN

SEQ ID NO: 8026 - protein, 261 aa, Acinetobacter baumannii
REKKMKHSILISGAAQGIGAEIARVFYQRGYKVGIYDINESLAQNLAQELGPNACAGYLDVSDYSQWQHILKEFTDWAGELNILVNNAGILYSGAFENIDIKSHQRTININVNGVINGCHAALPYLKQASFARVINLSSASAIYGQADLISYSASKFAVRGITEGLDVEWKKYGIRVLDVMPLFVQTAMVNNMDAGSIQNMGVDLTPNDIAQQVLSLVEKKAHFWTPTHTPVGIKTKLLYQLSTISPQFLNRLTNIYLSRK

SEQ ID NO: 8027 - protein, 276 aa, Acinetobacter baumannii
LREKMRFPTLVFDIETLTDLKAGAHLYHLDLPEADVEQALTKIRRQESGMDFQRLPLHEIVCISGLWIDESGFRLFSFSREHYSEAEILQKFLSIFDKRHPTLVSWNGSQFDLPVILFRAMYHGLSAPGLFDQGELDSQKRFNNYQNRYHHRHIDLMDVMAMFNGRNFQKLDDVACILGLPGKRGESGYHVPEYVRTEQWLKLTSYCEGDVLNTWFIYLRWLLLKGQMNVDEHNHWISSSIEYLQTMPQQADFLEVWQRTSKHTEFTSHYFNPLNF

SEQ ID NO: 8028 - protein, 306 aa, Acinetobacter baumannii
LNRNCYNLLRALENIMSDLRQRFYIEDFPVRGEVVHLEEALKTILAQRDYMPAVQILLGEMLSATALLASTLKIKGRISLQIQANGSFKWAMAECNHLGEVRALADYETDPRFGEATDSSTVLAALVNPVLFINIEPEHGERYQGIVPLDQANLAGCLMQYYDLSAQIPTRIVLASTAQRSGGLLIQLLPRHDEEEQKLVDEDLWPRLTMLTETLKSEELTELSANEILYRLYNEEEVRLPEVEHLKFGCTCSKERCAKALIQIGVDAVHETLEAQNPIQMDCQFCNTRYEFTAEEALGLFGEHLS

SEQ ID NO: 8029 - protein, 635 aa, Acinetobacter baumannii
MSRKLSHVLLIGVGLFSSTWVMAAVKEYDLTIAEQTVNITGKPLKRITVNGKFVAPLLEFEEGDDAVIRVHNKLKNQDSSIHWHGLILPGIMDGVPGFNKFDGIAPNKTYEYKFKVRQNGTYWYHSHSKGQEQDGLYGPLVIYPKNKVPLTAGEKADRDYVVLLSDFHNSTSGQIMSNLKKEADYYQNRRETVIDVFKQIKRDGLKATWKDRSMWNQMRMLKTDMSDVTNYTFLMNGKTPEQNWTGNFKAGEKVRLRFINASAMSLFDVRIPNLKMTVVSADGQPVKPVPVDEFRIGTAETYDVIVEPKQASYQIEAESIDRSGFSIGTLHDENTSPVKNIMMPTPRPRALLTMEDMGMNHDMSSMEGMDHDMSSMKGMDHDMSSMKGMNHDMSSMKGMDHDMSSMEGMDHDMTSMKGMDHDMSSMKGMNHDMSSMEGMNHDMSSKTMSSSGSDEVVYGWANASTPAGLKALQYSDLQSLTPQKDTRAPEREIEIRLGGNMERYIWTINGKKFNETEPFKVKYGERIRLKFVNDSMMAHPMHLHGMFMQLENGQDPSNMPNKHTVIVPPGKTVTTLLTADELGEWAIHCHLLYHMSAGMMNKLIVANVDSNSTSSKDVVTQPNTNDKGVNQHAHH

SEQ ID NO: 8030 - protein, 287 aa, Acinetobacter baumannii
KIRKDDEMNLSKKTIIALVVAAIALILAICVFVWKKPQSSSSSQENSASTQDHPVEKAEVLPYLNLTETKANYAVPFCEKKNCIDVDIQTIKTQDAWLNSWIEKNQAKVIQAQINLKKDLSLQQAINAYVKKSDEWQDKYSKNRAYELHIRTRIASQRNQYVLLQLALDSKQEEITIKDRYYFFVADRKLHKNLTLLDVLKKDQQPTVHQIVQTAYQDWLKKQTADVKKQAPKTLYWGQADWFFDGEGVGLHYQANQITKDAPQLDIYLTTEQTKKILQPQVYEQMF

SEQ ID NO: 8031 - protein, 441 aa, Acinetobacter baumannii
IKRKKREGRVKIFSTNTCPVPNDLESVIHHKDEVPAELGGMSEQQVQKIWKSIESLYKTGNYPLITFCLRRQGKILLNRSIGYAQGNSPAGLQKNALLATPDTPVCLFSASKMITAMLIHLLDEKGEINLLDPVSYYIPEYGVNGKRRATIFHLLSHRGGIPYVDGDVTPELLFDKDEILRRLYAARPVSPAGNHLAYHAVTAGYILGEIIERVTGQDLRQFVHETIEKPMDMPYFNYGLKPEYRAEVALNCATGLHPRLGTDHYLNHVLGGGLQLAVDVTNDNRFMDTTCPAGNIYTSAEQAGRFFEMLLSGGSYQGKQILSEKTIFRATLPTTGVNIDRTLLIPMRYALGPMLGSNPVGLFGPMTGQAFGHLGFSNILCWADPERDISVSLLTTGKSVVGTHLPALANLLYQISTQCPRIPRDQRRSLFGSDSHETDLV

SEQ ID NO: 8032 - protein, 427 aa, Acinetobacter baumannii
IERKNKIRRITMTTAQIELEELSVGADYEKVANRFRPIFEKIAQGAIQREKERILPFEPIQWLKEAKLGAVRIPRKYGGDGVSLPQLFQLLAELAEADSNIVQALRGHFAFVEDRLVAHKEHSQEVWFQRFVQGDLVGNAWTEVGNVQIGDVVTRVTKDASGNLVVNGEKYYSTGSIFADWIDLFAYDEVNDRHVIAAIYRHETGVSVIDDWDGFGQKTTGSGTLKVHQVHLPASHLIPFDQRFKYQTAFYQVVHLATLTGIARAAVETFSQEIRERKRIFSHGNGDLVRHDPQVLQVVGKASAQAYASEAITLKTAEALQKAYESHFAESEVKEHQFNVDAELESAQGQVVISNLVLDLTSQLFNALGASASSQVKQLDRFWRNARTVSSHNPLIYKEKVIGDWEVNRTDLPFVWQIGASPRAKTA

SEQ ID NO: 8033 - protein, 429 aa, Acinetobacter baumannii
SRCFKYRSGCCRRCLIKKKTLERIPSLVSFLFIPERFKRRNVPVSFPADSVGLVTPQKFQFEEPLHLECGRVLPRFELMVETYGTLNADKSNAILICHALSGHHHAAGYHHEDDKKAGWWDSCIGPGKAIDTNKFFVVALNNIGGCSGSTGPTSPNPENDNRPYGPDFPLVTVRDWVKTQAMLSDRLGISVWYAVVGGSLGGMQALQWSVDYPNRLQKCVVIASAPKLSAQNIAFNEVARQSILSDPDFHHGRYLENDSYPKRGLILARMVGHITYLSEEAMKQKFGRDLKSGKFMYGFDVEFQVESYLRYQGEQFSRNFDANTYLIMTKALDYFDPSREYGHSLTEAMSKTKCQFLIVSFTTDWRFAPSRSQEIVDALITNHKPVSYLDIDAEQGHDSFLFPIPLYVKTLRAFLGGEEHLKSTSLEAS

SEQ ID NO: 8034 - protein, 259 aa, Acinetobacter baumannii
FPLNNTPWVDEIKFNEQGLIPAIAQHHQTGRILMVAWMNRESLALTAEKNQAVYFSRSRQKLWHKGEESGHFQTVYEIRLDCDGDVIVLQVEQHGGIACHTGRESCFYRKLTPQGWEIVDAQLKDPTAIYGDKAKTESHDHTHTTEQVDVLAHLGQLMQERKQAEADTSYVASLYKKGINKILEKVGEESVETIIAAKDYAAQNTESNLNDLIYETADLWFHSIVMLGYFDLNPQLIIDELGRRQGLSGLVEKANRNKV

SEQ ID NO: 8035 - protein, 421 aa, Acinetobacter baumannii
PSLKVIKLVLMILRHCKGKCMANKRIAIIGAGPAGLMAAEVLSQYAYEIDVFEQKPSAARKFLMAGKTGLNISHAEPLAQFIERYDHAEWLKPWVEKWDAVWIQNWMKSLGIDSYVGSSGRIFPVEMKAAPLLRAWLKRLAEQQVKFFYRHRCINLKGTKVTLENQNNQSTETFTQQYDAVVLACGAVSWSQLGSDGAWQQWIDQSSIEPFQASNAGVLHTWSAFMESCFGEPLKRINAWVEPSQVTHGDIVITHYGLESGVIYKLGRALREQQKQGKSLNLFLDLLPDVELTQLVKKLQASKKQSLTNIWRKAGLDTAKINLIREVVDKSLWSQPEVMAQQIKALQIRLDGFRPIEEAISCAGGVKQDVLTESLELKQTSGVFCCGEMLDWDAPTGGYLLTACFATGRAAGEGVHSFLEK

SEQ ID NO: 8036 - protein, 729 aa, Acinetobacter baumannii
EFMKLQTIACAVAIATGGLFFSHTMNEARAATNTAAVSQSIQPTQEQALVARQLATLVDRQHYLNMRLDANTSNRILDMYLDSLDPDHSLFLDAEVQNYKKLYGSNFGASLKAGNLTGPFAIHQQYRERLKQFYEFMLAELKKPQNLKQPNTFIEVDREKAPYFKTSAEQQNHWRKMLVSQLINLTISREEEQAKQKALKENPSLADGQDLTGPEDLTPAQTLTKRYTRQLERISRVKSDDVLDKTLNAMLATYDPHSNYYPPIDAIELNRQTTLQLEGIGVSIRPERGNEDYTKIETIVEGGPASKSGQVKSGDRIVGVAQEGGKMIDVVGWSSSEIVGLIRGKRGTKVTLKLLGAGASMSQARNVTLVRDVIQEEDAGVRSRTVEVTRDGKKHLLGVIEIPSFYFDYRSRRAGQQYRSVSEDTANAFEALKAKKVEGIIIDLRNDPGGSLEEVARMLGQVIKSGPVVQIRDGNGNVSVFEDNDGGQQIYTGPLAVLVNLASASASEIYSAAIQDYERGIIIGSTTTGKGTAQVQLDTLAYGQATLTQRKFYRVTGGSTQNKGVVPDIKLVDIYNEEFGERKSKNALKWDTIPTAPFKREGSVQPYVAKLSQLSEQRVAVDPQFKYLNKRTAIAKVTSDQKQVVLDIDKRRAELLSLEKQTLDAENERRIATGQKPFPNWESYQASLDALAESRAKMKANQRPALPEEETFVNEAANVLMDYAKLQNR

SEQ ID NO: 8037 - protein, 170 aa, Acinetobacter baumannii
NIMKIDNIPDYIDPSLNLEQIRDECQELIQKRAYVSAGAAIVPIPFFDVVVDLGILSQLIPDINSRFGLAPEHVSVYDPKTKTIHWDELRKRGFQFSGFVVARTTVKKTFNGFFGKIVTKQVTKFVPLGGQLVAASLGYFMMKKIAQTHLNDSYNLAKRIQQKSRGTVVN

SEQ ID NO: 8038 - protein, 716 aa, Acinetobacter baumannii
VYMNTILLIPTGEGVGLTSACLGMIYALDCNGIKAGFLKPFSQVDQENLDRTTSLFGHLFQSKTVQSISHEKLTQRIAAGEVDELLEEAVSLHRSIAADNNVIIVEGLLPNGQDHFASELNASLAQALDAEVVLVSTADIQNPRKTAEKVEAHLRQFGGATSNRTAGVLFMRTRGLSEETAQIPVAFDPSLRPTEDIAKFTTELQKYNRYFGSSDLPIIGLVPFSNTLSVPRTLDIASVIDGQWVNQGEAKTRRILHSSLIASSIEYELNKFIAGELIISASERTDVLLASSLATSNGIPLAGLVLTEREAPAPKLLEFCQSAIKQGLPILHTHLNTLETAQRLSDFGNEIPTDDTERAEQVTRFVSSHIDVEWLKQHSNNGATPRLSPSAFRHELVQKSIAAKKRIVLPEGDEPRTIEAAAICQARGIAHCILLAKPEAVHDVAKARGIELPTGLEIIDPDQIRDQYIAPMVELRKGKLNDLQAKEQLQDTVVLGTMMLALDHVDGLVSGAVHTTANTVRPAFQLIKTAPAYSLVSSIFFMLLPDEVYVYGDCAINPDPTAEQLAEIAIQSADSAKAFGIDPRIAMISYSTGTSGTGADVEKVQQATQIAQQRRPDLLIDGPLQYDAASVESVGRQKAPDSRVAGRANVFIFPDLNTGNTTYKAVQRAANVVSVGPMLQGLNKPVNDLSRGALVDDIVFTIALTAIQAEQQAAAK

SEQ ID NO: 8039 - protein, 66 aa, Acinetobacter baumannii
VPMNSQTKTNPETQVPYDVKHLHDLLEQQKIAYLRHPVPTAKERIDRLARLKRVLVKYQDQIAEAM

SEQ ID NO: 8040 - protein, 100 aa, Acinetobacter baumannii
RCSKNFGIEIRVLKMNLFQVKPNEFVKIVDLKKGNQYLDKNDPVLERLELLGFRIGETLQVLAKGLFGGDPVLVQIETSRFALRKNEAERIFVEIVSNEQ

SEQ ID NO: 8041 - protein, 297 aa, Acinetobacter baumannii
NFPKLSSTAMTAIQPLFTELEPMPKALADAPIGIFDSGIGGMSVAAEIAKYLPNERIVYYADTAYVPYGPRSDEEIRELTARAVDWLYRQGCKIAVVACNTASAFSLDHLREHYGEHFPIVGLVPALKPAVLQTRSKVVAVLATPATFRGQLIKDVVEKFAVPAGVKVMTLTSLELVPCVEAGQQMSPVCLNALREVLQPAVEQGADYLVLGCTHYPFLNEAIRHLFDNQFTLVDSGLAVARQTARILIKNELLCDQIRQNIARIECYVSGNNADALQPVLQNMIPQELTWTLHNLS

SEQ ID NO: 8042 - protein, 118 aa, Acinetobacter baumannii
EDEKYEMEQIEWNDFLKVELRVGKIIQAEVFEKARKPAYILHVDFGEELGVRKSSAQITKLYQPQDLIGKLVVAVVNFPKKQIGPIQSEYLVTGFHNADGDVALCIPEFEVPLGTKLL

SEQ ID NO: 8043 - protein, 399 aa, Acinetobacter baumannii
NRENIMSTPEDISQNKPLLWLMAAACGLCAGVNYYCQPLIHSIQQDFAVTQAQAALTVTFAQVSYALGLLFIVPMGDIVNKAKAIPFLMMLCAVGLFTSAFAVNLPMLWIGTILAGLFSVAAQVLIPLATMTVKPEKTGEIIGFLMSGLLVGILLSTSLAGLFSNLFHWKVVYAISGILMLLLAYTLKSRLPYVMRMKLNYGQIFVSMAQLLKEEKRLLLRALTGAFAFASVSILYSTIAFLLTSAHHLPDLFIGLVPLVGIFGALSTRYIGKYADQGYTRLLTWMGCGLFLVSWICFYFGQTLLSAYVIGFALIQLALALVHTSNQSIIFRLRPDAKSRINAIYMTTYFIGGAAGSALGIFAWNRGGWTMTCLAGVGLVVFCILFSMIDAFLQKKQMA

SEQ ID NO: 8044 - protein, 304 aa, Acinetobacter baumannii
RLRNYMNYSNLLLSSLLTVGLYTSAHAQENLTEESAASSEDVTSTQTQHSRPHLQIIKDLKGIKVKDLKINANAAQPDTVKDPLQSLNRPIYSFNDMLDRHVLRPVAVEYREKTPEDVRGSYRQFRKNLGEPWNAVNQLIQGRPGRAAKTLGRFTINTLTTLGLADPASRLGLPPEEESFGVTLGYYGVPSGPFLMLPFFGPSTLRDGVGLAVDAQARPQKYIMDDQDGLYWSTNLLQAVDTRAQYLDLDQTIQGDQYAMIRDLYLQRKAFQIAEKKGDSADVSFIDDDESEDVPEDNTDKTEK

SEQ ID NO: 8045 - protein, 336 aa, Acinetobacter baumannii
KKRKLRFKKIQTFYLAKKQLIDLTLSDAIDKYLDEVGSEYGRTKRYSLLLIKKLPIARNIITKIHSIHLAEHVALRRRGVPNLGLDPIATSTQQHELLHIRGVLSHASVMWGMEVDLSSFDKATAQLRKTRQISSSKVRDRLPTNEELIALTKLFAERWKLNKYGTKYPMHLIIWFAIFSCRREAELTRLWLQDYDSYHSSWKVHDLKNPNGSKGNHKSFDVLEPCKTIIELLLDNEVRSRMLRLGYDEQLLLPLNPKSIGKEFREACKILGIEDLHFHDLRHEGCTRLAEQSFTIPEIQKVSLHDSWSSLQRYVSVKSRRNVIQLEEVLRLIDET

SEQ ID NO: 8046 - protein, 82 aa, Acinetobacter baumannii
ICGNSYLAALISLHLHQNLHHNGENGSWCKFMGSITARKGADGSVSYRAAIRINKKGYPAYSESKTFHSKKVAENWLKKRGS

SEQ ID NO: 8047 - protein, 142 aa, Acinetobacter baumannii
NQGKNHMQYSIRFWKNKYFVLIILCLGVISPSVYAQSFDQNFQEWKAKQQMYDQKLNITKSSHSNGSKISQTKNFNDSTGQIHLNQANVNEFQQLKGIGEKKAQAIVEYRQKNGSFKNIDEIKNVKGIGPAIFEKNKSRLAL

SEQ ID NO: 8048 - protein, 323 aa, Acinetobacter baumannii
WFNLYDGTFNYGNFRGARRRSGNCYVSSNFPNGLSCIMQDIIAYFIQNLTALYIAVALVSLCIGSFLNVVIYRTPKMMEQDWQQECQMLLNPEQPIIDHEKLTLSKPASSCPACQQPIRWYQNIPVISWLMLRGKCGHCQHPISIRYPAVELLTMLCSLVVVMVFGPTIQMLFGLVLTWVLIALTFIDFDTQLLPDRFTLTLAALGLGINTFNIYTSPNSAIWGYLIGFLCLWIVYYLFKVITGKEGMGYGDFKLLAALGAWMGPLMLPLIVLLSSLLGAIIGIILLKLRNDNQPFAFGPYIAIAGWVAFLWGDQIMKIYLGG

SEQ ID NO: 8049 - protein, 303 aa, Acinetobacter baumannii
SNFEMIMLTLKQFQYFIKIVEEGSFTAASEKLFIAQSALSRQMKLLEEEIDFQLFDRTDKRVKLTVAGEVFYKKIKDNLLYLNEIIDLSKSVSEGKNRQIKIAHSSSIVVDNTKVQILKEVSLTQQLSFEINTLSSEQQILALLNGEIDIGLIRPPVRHTLDGINTLKLYEEPLMVAVHIDHTKFAKSEKVYLKDLKDECFVSTPHAERGGLSYLVANLCLAAGFTPQKTSIQSRKISQLQLVAANLGVGIVPAEFQQILPANVKLIPLEDSLSLSEVLLVYRKDHDEIIQHCAEQIHQMFLS

SEQ ID NO: 8050 - protein, 488 aa, Acinetobacter baumannii
EGFDMEFIQANANWLYLIGAILFILTLRGLSGPKTAIQGNRYGMIAMAIAVVTTFFVANNPVIWMIGGAMVLGAIVGIARARTVPMTQMPETVALMHSLVGLAAVLIAVAAILHNNQLTALFAQNEAALTAAGVQHAHMSKVHLFELFVGCFVGAITFTASVFAYGKLAAKKWAKTISGAWVKPVQALIFVAMLACGFYFFTTGNMTAFWAMTALALAFGWVWIAPVGGGDMPVVVSLLNSFSGWAAAGIGFTLENNMLIVAGSLVGSSGAILSYIMCKAMNRSIINVLFGGAMGGAAVSTAAKGEQVQRNYRSGSADDAGFLMSNADSVVIVPGYGMAQGRAQNAVKELCEILKEQGVRVRFAIHPVAGRMPGHMNVLLAEADVAYEDILEMDEINSDFPATDVVLVIGANDVVNPAAKDDPGSPIYGMPILEAHKARTIMVIKRSMATGYAGLDNDLFYNEKTMMIFGDAKKVVEDMTKAINGTGH

SEQ ID NO: 8051 - protein, 119 aa, Acinetobacter baumannii
APFDRKFKIMAQELLAQLQAGTAKFSDVLAYIEACYQHTPTAFQNGAQHNAATENQGSAKVFSFAKLQGLDQAQTLSLFAEHYASVLATPEGTDHQNIRQFMQNGWDGVKFEGQALTEK

SEQ ID NO: 8052 - protein, 146 aa, Acinetobacter baumannii
PMLDVGMTELLCFAIIAILVLGPEKLPEAARFAGRWYVRLKRYITNLQNEIDQELRLSEFRKEMQEELNRIEALERKVQQQLEEIQKQQVSESLEATETAKTTQKPIWKCTPISGHYKVPYLTKVKPLAPQTDISETSPVELKIAV

SEQ ID NO: 8053 - protein, 74 aa, Acinetobacter baumannii
TGLDLERYSKSLTSLNRFVQGYLDCPHTYPPSFPHACPHGYRQAYPHPKYLLILKLDHLSAFFMQFYPQQSTLK

SEQ ID NO: 8054 - protein, 185 aa, Acinetobacter baumannii
KSTETYGAITMQLSKLLDRWFPHPFVSFLIIIFWLMLAHSLDASDLLMAVVLGLVIPRLVRPFITRTPHIHWKPAIKLCFVVLWDIIISNFRVAKLVLGSPKKLHPKWYRVPLETEHEQVNSLLAMIITTTPGTVSAGIDQERGDILVHSLSTENTESDVQDIKQRYEAPLMEIFDVKSKSEDNA

SEQ ID NO: 8055 - protein, 787 aa, Acinetobacter baumannii
IKYEGGLYMDHYHEKKTINDTHNDPVCGMAVTEESKFHEQVGNNTFYFCSEKCQIKFKHDPALYLAKEDGSAFTNVSLNKMEAQSNSINTSSIYTCPMHPEIRQNHPGNCPICGMTLEPLLPNLDEVDENPELKDFKRRFWYTLPLTLIVVFLAMFGHQLNWFEMKVQSWIELVLTLPIVFWAGWPFFVRCWQSILNRSPNMWTLIGIGTGAAFLYSLVGTLAPQVFPDSFISMGRVAVYFEATAAIISLTLLGQVLELKARSQTSAAIKSLLGLAPKTARKINEDGREEDIPLSHVHVGDLLRVRPGEKVPVDGVITEGSSSIDESMLTGEPVPVTKRIGDQVIGATMNMNGSLVMRSEKVGSSTVLSQIVQMVAQAQRSKAPMQRMADQVAGWFVLVVIGISILTFFGWGIFGPEPSWVYGLINAVAVLIIACPCALGLATPMSIMVATGRGASNGVLFRDAAAIENLRKIDTLIIDKTGTLTEGSPSFDKVFALSGYEENEVLRLAASLDQGSEHPLADAIVRAARERNLVLTTPTSFESSSGIGVKGELEGQQLSLGNTALMEQLGISVDAYIPQAEQLRAEGASVMHLAVDGKLVGLLAVSDPIKASTPEAVHALKNSGLRIIMATGDGLTTAKSVGARLGIDEVYGEVKPADKLELVNKLQKEGRMVAMAGDGINDAPALAQADIGIAMGTGTDVAMNSAQVTLVKGDLRGIEIARSLSEATIKNMRQNLMFAFLYNALGIPLAAGILYPFTGWLLSPMIAALAMSLSSASVIGNALRLRS

SEQ ID NO: 8056 - protein, 335 aa, Acinetobacter baumannii
ISCEKTKLIGHLLIKFRKISGLNISMNSTQQWQSVTWFEVDEHQAGQRIDNFLFSRLKGVPKSRIYRLIREGQVRVNKKRIKAETKLAIGDQIRVAPIRYEQKDETAVPVSDSVAQGLLSRVVYEDEGLLVVNKPSGIAVHGGSGVAYGLIEALRAATGKKYLELIHRIDRDTSGLVMISKKRSTLKMLQDMLREHKIRKTYAAIVKGQVSLDKQLIDAPLFRYELANGERRVRVSKEGKPSKTEWVVAERFKNATLVHASPLSGRTHQIRVHGLSIGHPLVGDDKYGHNTAYTGPEARRLCLHAMRLDIPGYPTIEAPLPEDMTQLLEALRVAK

SEQ ID NO: 8057 - protein, 292 aa, Acinetobacter baumannii
FTREFYTWNVDIQNEYDVRINTPIALPQNRPHADLDDWQVWFVGHATVLIQIGPYNFITDPVWCDYASPLHGRGPRRVCPAGFALEQLPTIHGVLLSHNHYDHMDLATLEWLHKKFAMPIYTGLGNGFYLPKEFHVIEMDWWQEIPYHELRIVYTPAQHGSGRGLRDQNKALWGGFSVLAKTGHCFFAGDTGYAGHFKQIHTRYGAPRVALLPIGAYEPRKLMSYVHMNPQDAVHAHLDLQAHRSVAIHYRTFQLTDEGREDPEHALAQAIKASSKLANPFYCIREGHKLTV

SEQ ID NO: 8058 - protein, 640 aa, Acinetobacter baumannii
FMSEQASQNYSFQAEVAQLLHLVTHSLYSNPEIFLRELISNASDACDKLRFEGINHPEYYENDPNLHVRISLNKEDKTLTISDNGIGLSQQEAIDNLGTIAKSGTKDFMAKLTGDQKADAQLIGQFGVGFYSGFIVADKITVESRRAGLDASEGVRWISGGTGEFEVQQIDKASRGTDIILHLRDDALDYLESYKVKQIVNKYSDHISLPIEMQKEVWQEEEVAEGEEPKGGQMVKTDEWEAINSASALWTRNKSEVTEEQYVEFYKNLTHDFEAPLAWAHNRVEGSTEYTQLLYIPSKAPHDIFTREAKAGIKLYVKRVFIMDDADNLIPNYLRFVQGVVDSADLPLNVSRELLQESRDVKTIREGNARRVLTLLDGLAKSEDEKDQEKFKTFYTEFGSVLKEGLGEDFGNRERILKLLRYATSTNDEVTTSFADYKARMKEGQKAIYYVTAESLAAAKNSPQLELFKKKGIEVLLMAERVDEWAMNFVHEFDGTPLKNVSKGAVDLGDLQDAEEKKALEQAAEQFKPVVEKLSDSLKAKTKEVRVTTRLVDSPACLVTSEGELSPQLIRMLKQAGQAVPEIKPILEINPEHPLVKKLEGSEQFDDLANVIFDQAVIAEGGLPEDPAAYVKRINSLLLK

SEQ ID NO: 8059 - protein, 282 aa, Acinetobacter baumannii
TSFDTCRKKYQLMHLFDTHTHFDVADFDEDRQQLALEAKKVGVDALVLIGFLQSRFDELVHTHHQLKQWENVPTSYLAPGLHPFYIEQHKPEHLSHLEQILQQEECVAIGEIGLDTFLKEHKQPDIYAKQKQYFADQLDLATQYQKPVLLHIRKAHGDVLALLKAHKFKLGGIAHAFSGGVEEAKGLIKLGFKIGVTGQITNPNAKKLHTVVQAIGAEHLVIETDCPDMTPLCCQTSTEQRTRNTPVNLPYVLKSLAENLNMAESELADLLWKNSLSALKLS

SEQ ID NO: 8060 - protein, 286 aa, Acinetobacter baumannii
SELESVMRAYLDLLQHILDNGGDKGDRTGTGTRSVFGHQMRFDLSKGFPLLTTKKVHFRSIVIELLWFLKGDTNVKYLQDNKVTIWDEWATAEQTARFGRPEHELGPVYGHQWRNFGATKNADGTYNQDGFDQIKWLINEIKTNPNSRRLIVSGWNPNEAGQVALPPCHTLFQFFVQDNKLSCQLYQRSADVFLGVPFNIASYALLTHMIAQVCGLGVGDFVWTGGDTHLYANHFEQAKLQLTREPLPLCQLKLNPDVKDIFDFQFEDIEIVGYESHPAIKAPVAV

SEQ ID NO: 8061 - protein, 287 aa, Acinetobacter baumannii
AKCLNFIANLDVYMTLVSVVQMNSQDDIESNFQVIESLIQQSKAQNASLIVFPENFVCFAAGKQRETAEQFESIQQRLEKLAHQYQIWIVAGTLPCPFRPDGSIIQDGRVRTVSLCISPERTEARYDKIHLFDVQVGDAVGGYQESRFFEPGTDVVVTSTPFGNIGLMVCYDLRFPELALTLRQQGAHLLTAPAAFTYTTGQMHWQLLLQARAMDSQCYVLGAAQQGWHGEKRQTWGHAGATDSRGQVLSMIGYEGNGLITVPFDLATQELVRTSMPLMMHRKLIHY

SEQ ID NO: 8062 - protein, 65 aa, Acinetobacter baumannii
AERDLISENRELTNFSALSKHEKTKVISLYQVRLRDNAECFHKKVVANENTSHLLLWHFIVLSDV

SEQ ID NO: 8063 - protein, 180 aa, Acinetobacter baumannii
ISLDYGLENKIMAWQNVEVVHVVAMDKNHCIGKGNALPWHISADLKHFKEITQGGVVIMGRKTLESMGRALPNRVNWVITRDINWHFDGVKIAYSIEDALNAALEDAKNTEKQALFIIGGGEIFKQTLSIADRLELTHVDLDVQGDAHYPTIPSEFHKTASEQQVDEKSGTSFEFATYKK

SEQ ID NO: 8064 - protein, 1065 aa, Acinetobacter baumannii
HFQDVYDIYEELNGRTIMIARVIRFSIANRVFVLLAALILAAWGTWAVKNTPVDALPDLSDVQVIIRTNFSGQAPQIVENQVTYPLTTTMLSVPGVKTVRGYSFFGDSFVYVIFDEHTDLYWARSRVLEYLNQIQGKMPANAKSSLGPDATGVGWVYEYALVDPTGQHDLSELRSIQDWFLKYELKTLPNVAEVATIGGMVKQYQVVLDPSKMATLGVTQNNVIEAIQKANQETGGSVLEMAETEYMVRASGYLKTLDDFRQIPLRTNSFGVPVSLGDVATIQLGPEMRRGISELNGQGETVGGVVILRAGKNARETITAVKAKLAELQQSLPKGVQVVPVYDRSQLIDRAVENLSHKLIEEFIVVALVCGLFLWHLRSAMVAIVSLPLGILSAFLVMHYQGLNANIMSLGGIAIAIGAMVDAAIVMVENAHKHIETWQHEHPEQVLEAQVRWNIITRSASEVGPTLFFCLLIITLSFIPIFTLQAQEGRLFSPLAFTKTYAMAAAAGLSITLIPVLMGYWIRGKLPSEQRNPLNRFLIKIYSPMLDKVLAHPKTILLGALLIFLISLFPLTRLGGEFLPNMDEGDLLYMPSALPGLSAAKASELLQQTDRMIKTVPEVATVFGKAGRAESATDSAPLEMFETTIQFKPRSEWRSGMTPDKLIKELDKAVQVPGLTNIWVPPIRNRIDMLATGVKSPIGIKVSANDLQDIDRVAQQIEQVAKQMPGVSSALAERLTGGRYVDVDINRMQAARYGLNIKDVQQIVSSAIGGENIGETVEGLARYPINVRYPREIRDSLEALRNLPILTESGQQIVLSSVANIQITDGPPMLKSENARPSGWVYVDVQGRDLASVVQDLKQAIDQKVKRSSAMSISYSGQFEFMERANARLKVVIPITLMIIFLLLYLIFRQVQDAVLIMATLPFALIGGIWAMYLSDYHFSVAIAVGFIALAGVAAEFGVVMLFYLKQAIEHAQQSLSSSTASLTEQQLNEAIHTGAVLRVRPKAMTVAVILAGLIPILLGTGTGSELMSRIALPMVGGMISAPLLSMFVIPAAYQLLIKRKLSKN

SEQ ID NO: 8065 - protein, 186 aa, Acinetobacter baumannii
MMKDEKFLNDLIQKIQQGHQFKYLYFWGHTPKKANLIDKSCFSQWFPAQFNVEGIEYFTAEHYMMAQKAKLFNDKEIFAQILQVKHPNEAKQLGRKVRNYNEQIWQEKRFDIVVQANFAKFSQHPELKKFLLATKDRILVEASPVDKIWGVGMAQDHPHIQDPSLWQGLNLLGFALIHVRELLLTE

SEQ ID NO: 8066 - protein, 436 aa, Acinetobacter baumannii
GIEDMAKNASSPGKRFMKLAGMTASIATKTVSNSIRNLTADEEQKLAAKTKLFQDIGLQIADTLGEMKGAVMKVGQIASQYKDIFPPEVAKAISKLQRQAPAMPFAAIQQQVERELGKPLNVAFKSFEQEPFAAASIGQVHKAVLPSGEQVVVKVQYPGVDEACESDLKQVRLALRLMGVLKIDKKLQDQLFAEIQDSLSAELNYEIEAQNLEVFKTFHSKLDDKIIIPTVYKDYSSRRILTLSLEQGDSIETASSWPIEIRNTIGRRLIRALGQEMFFLKRFHCDPHPGNFAFRQDGSVIIYDYGSVKTLSNEIVYSFKRLVNAARHEDIDLIETELLELHSLAEKGKFPSELYKLWIEVLLRPLTTTYDFAENSSHHDGMLLVKKSLKYWDVFKPSPDTLMVNRTISGHYWNLIHLKVHDNLNDLFEELVPLSN

SEQ ID NO: 8067 - protein, 113 aa, Acinetobacter baumannii
IRREMQSARVLCHHVETWRKYMSIQQLKELFGNQEAVLELVQLEGGELALRNAGSEKEPLVKIQFSDELKAILGEQTPIVAQHMIQAALFGLLEKQVNEWQAEVVDEQPKFLS

SEQ ID NO: 8068 - protein, 576 aa, Acinetobacter baumannii
ITLELLSGGEMLVRALADEGVEHVFGYPGGAVLHIYDALFQQDKINHYLVRHEQAAGHMADAYSRATGKTGVVLVTSGPGATNTVTPIATAYMDSIPMVVLSGQVASHLIGEDAFQETDMVGISRPIVKHSFQVRHASEIPAIIKKAFYIASSGRPGPVVVDIPKDATNPAEKFAYEYPEKVKMRSYQPPSRGHSGQIRKAIDELLTAKRPVIYTGGGVVQGNASALLTELAHLLGYPVTNTLMGLGGFPGDDPQFIGMLGMHGTYEANMAMHHADVILAIGARFDDRVTNNPAKFCPNSKVIHVDIDPATISKTIMAHIPIVGAVEPVLQEMLAQLKQLNVSKPNPEAIAAWWSQINEWRKVHGLKYENPSDGTMKPQQVVETLYKVTNGDAIITSDVGQHQMFGALYYKYKRPRQWINSGGLGTMGVGLPYAMAAKLAFPDQQVVCITGEASIQMCIQELSTCKQYGLNVKILCLNNRALGMVKQWQDMNYEGRHSSSYVESLPDFAKLMEAYGHVGIQINHADELESKLAEAMAINDKCVFINVMVDRSEHVYPMQVAGQSMRDMWISKGERI

SEQ ID NO: 8069 - protein, 90 aa, Acinetobacter baumannii
MKLLGLEKITVIECEFAKKWLISWISEIRDAHWRGAEDILKQFPKVSILENQCFEFSIHNSKWVICLQIAFSQRIAIIKAVNIKGANNGI

SEQ ID NO: 8070 - protein, 221 aa, Acinetobacter baumannii
FGLEQAMKAYTVEQGIVAPLDRANVDTDLIIPKQFLKSIKRTGFGDNLFDELRYLDEGYPGQDNSVRPKNPDFVLNQPRYQGATVLIARTNFGCGSSREHAPWALNEYGFRTVIAPSFADIFFNNCFKNGMLPVILPEDIVDQLFKECAAQEGYQLTIDLAAQEVRTPTGEAFKFEVDPFRKHCLLNGLDDIGLTLQNADAIRAYEEKTKQVRPWVFQEIN

SEQ ID NO: 8071 - protein, 265 aa, Acinetobacter baumannii
GRMEINPNSQQPTGSSLPTSALGNIQRPGEYLRQIRVSQKKELEQVSLDLNMPLKTLNALEQDDYKSLPEATFIKGYYRSYAKYLNTDATAIIQRFDEIYANDTGLLPNHALNNSPIKIMGKLPGSNSDRNKKWLKRALLAILIIAVVSLIVMGVQKWTSNKEDAELPKANQSNVEVLPMKGNTSATVGDQLVLNFNRPTSVHIVDATGKVLATGRQASTLTLNGESPFQIRLDDATAVSLSLNQEQISLSPYTVNGKAEFRLSR

SEQ ID NO: 8072 - protein, 900 aa, Acinetobacter baumannii
NMTDKSIKELALSVGRPVEKLLEQAREAGLPQRTADDIITTEQQDTLVNYLKKVHGQESGNTGKIALKRKTTSTAKVASTSGKAKTINVEVRKKQVFAKPNPEQIAAEAKARAEAEAKARAEQQAREAAEQKARLQTEQKAKATLDAMRAAHQQDSAAQSAPKAAVVVKKRGGGTVKPAPKPAETLEQKKAREAQTAQLKATEEAARRKAAEEAQQRTLEQMRKMASKYSNDDATATIRVIDDSPLASGLVGQAYEDSFNQEDREIKRGGATTNPRAGKKGGRRGQEEQSFVNHNKRGLKSSQANKHGFEKPVKKQVYDVEIGSSIVVADLAQKMAIKVREVIKTLMKMGELVNQNQTIDQDTAALVVEEMGHNPVLVSDTQAEDNLLEAAEEARGEQTTRPPVVTIMGHVDHGKTSLLDRIRRSKVAAGEAGGITQHIGAYHVETDKGIITFLDTPGHAAFTSMRARGAKATDIVVLVVAADDGVMPQTAEAIDHARAAGTPIIVAINKMDKESADPDRVLNELTTKEIVPEEWGGDVPVAKVSAHTGQGIDELLDLILIQSELMELKASAEGAAQGVVIEARVDKGRGAVTSILVQNGTLNIGDLVLAGSSYGRVRAMSDENGKPIKSAGPSIPVEILGLPEAPMAGDEVLVVNDEKKAREVADARADREREKRIERQSAMRLENIMASMGKKDVPTVNVVLRTDVRGTLEALNAALHELSTDEVKVRVISSGVGAITESDVILAESSEAVLLGFNVRADTAARQKSDQDGIDIRYYSIIYELIDDVKDAMSGKLAPEHRETILGVAQVREVFRSSKFGAAAGCMVMEGVIHRNKPIRVLRDDVVIFQGELESLRRYKDVVDEVRAGMECGLAVKGYNDIKPLDKIEVYDVQMVKRSL

SEQ ID NO: 8073 - protein, 150 aa, Acinetobacter baumannii
FSEEYMDQDCQNLKLENQLCFLIYSTNLALNQLYRKLLTPLGITYPQYLVMLVLWEKDEITVSEIGSKLFLESSTLTPILKKLEALQLLNRTRSKEDERQVIITLSEKGKKLKEQAVNIPTHILEASSCDTATLLGLKDQLTQLRTNIAK

SEQ ID NO: 8074 - protein, 421 aa, Acinetobacter baumannii
CGLFLWHDASNTSIDRHGMQVYYFYRHQSDGYVFLSREKHTEHILEFFWIDSVRSDVVSQNEEWQQKIQQLADVSINEFHMRDIANIEHPCAFDTLEEYDLLIFRKLVTPDDEIKNGESHESVFGLATTPISFIFTPKVLISVREQGNKSIENYIQRLENILCKTLEEQNKTRKLPNSPVDLCLRLLNSMVDGYLDIRSPLTRRVEHWQQQLLQGNRRFKQWHQLFHENMAFQQVENLCEEQIETLQEFRDEIVENYHHVIGEKTHSSQDLLLVRLNDLMSHVERIQKHTLRLRSAIQSAIDLHFSAIANQTNENMRILAIITAVFAPLTLLTGIYGMNFEFIPGLKSPVGFWIMLGVMLLSTILLLYYFYRQHLVGRGEKSVIDLLAQQHRQDRMNLFWFLEYEPIKQTLKEVEKITRLK

SEQ ID NO: 8075 - protein, 645 aa, Acinetobacter baumannii
KKSFKSMVNHENYWTFCPHNLFWIDRKINRIDMSQTTQTDIITLGDVATRLPSFIPKVPHILNGLKQAYLRTSNTPTGLGIAFEKAVKRNPKGTALLFEDQSYSYEALNEWANQISHYYLSLGARKGDVIAVMIENRSELIATIVGLAKIGVTIALVNTSQVGKVLAHSINLVKPIAVIAGEEVRAAIDEIRQDLNVPKDRFHWFADQATRQNSGTAPEGYVNLADQIDQFPKFNPSTTRSVTGNDGLFYIYTSGTTGLPKAVIFKHSRWTLAYGTYGHILNLGPDDVMYVTLPLYHATGVVVCWCGVIAGSATLAIRRKYSTSAFWKDVQKFNASAIGYVGELCRYLMDAPVTELDRNHRVTKMIGNGMRPNIWDKFKQRFGVKEVLELYASSEGNVGFSNIFNFDNTVGFSPTPYAIIQFDKEKNEPIRDKNGWCQKVKAGEVGLLIGKITSRSPFDGYTDPEKNKSVIWKNVFKKGDSYFNTGDLVRDIGFRHAQFVDRLGDTFRWKGENVSTTEVENMVCEYDKIAEAVVYGVEIPNTNGRAGMAAITLADGEELNDADLTEMVTVFKKCLPTYAVPVFLRVQKKVETTGTFKYQKNKLKEEAFNPSKTSERLLALLPGASSYCDITTEIFDNIQAYKYRF

SEQ ID NO: 8076 - protein, 264 aa, Acinetobacter baumannii
MSLLQLWEDVKQNEWIDIPAGWLQGRTVFGGLVAGLLMQKACSYIQDSNKRLLSCSVTFVGPVQQGAARLTIEVLREGKSVTTLEARLWQDDAVQTILVASFGASRASSIEVKQEPVVPAYVPPENLSVIPFAKHMPECFQHFEVCWAEGNYPVTGSKHPDFGGWSRFSPEQHANRQMTLSDLIVLMDIWPPGVLPMFKQVAPASSLSWHITYVHPVRHQLCDWFKYKVTTEYAAEGYSTEYAYLWDQNDHLIAILRQTVTVFT

SEQ ID NO: 8077 - protein, 209 aa, Acinetobacter baumannii
AFILYNSKVNQKISMTGQPMSKRETIITTAMTLFNQKSYTSIGVDKIIAESKVAKMTFYKYFSSKEVLIEECLRRRILEVQTSLLDKVNSVDDPLNKLKSIFNWYIDWINTEDFSGCLFKKATIEVLQLYPSIKKQVNKYREWIYSLVLSIFLELEIEDPKVLSSLFLNIIDGLIIDGTINKPEINSEETWSYINKLIELETKQKYEAA

SEQ ID NO: 8078 - protein, 173 aa, Acinetobacter baumannii
RKGFSIKKFSCCFFNLILNREFTLLSSLFIKNSLFLYKTIHSKLLIYKVYLNIISLHWGRTDMNLSYLKTSLYTAATTAILLCSSQSQAQQYYKWMDQSGSTHYTTTPPPKGAKHLNKVSTYGSQPLLKNPTSNSEQPSQDKDKVVQEVTNVAVEKGAPAVPVPPAPSVSAPR

SEQ ID NO: 8079 - protein, 306 aa, Acinetobacter baumannii
DIFWISLMELRHLRYFITVAEELNFSKAALKLYTAQPSLSQQIKDLEEDVGVRLLNRTKRKVELTEEGEVFLEHARLTLAQADKAVAMARQVSKAKQQLLRIGFVPIAEMKIFPYVLPNLRLQHPDLTIELSSLNNAEQLKALKRGELDITFTRDNTENDEIQSQFVLTEPLIFLLPRNHPLAKYDRIPVKALHGIDFIIPAAEQSNTLHNTILEFTKTHGIDLNIVQKADSILLNINSIGSGLGCTILPAYVAPLGVSNTVVRPLDVELPSLDLFVSYRKNTESVGVKRFIDQLNKVFHLDKNLD

SEQ ID NO: 8080 - protein, 330 aa, Acinetobacter baumannii
VMKLDYLQALKRIPEARGAWILHGQEPLLEQNLLDTFRKSWQQQDIERQRYDISSVSDWKNVFNALNSLSLFSQQLAIEVHGNIKPDANGLKQLKSYIQHNETNLLLIVLPKQDSSSLKSAFFQVVEANGVVVALTANYPQDRQRILAAEAEKLEIQLDNDAWQWLMQHHEHNLLAAKNSLMRVRDTFPDQKLIQIEQLYACLQDQSRYTTYDLSDALLEGNLAQSIKIFQYLIGSGEPESLILWTLSKEMRLLMQLFEQPHNALQLGIWKTKVSLYQQALRRLNPQQFLGWSALLLQIDAAIKGMSNENAQHLMQQAIAELCGKTLFIH

SEQ ID NO: 8081 - protein, 205 aa, Acinetobacter baumannii
KFIWEVKMAFILGITGGIGSGKSAATQWFESQGIQVVDADIVAREVVEKGQPALQKIQQTFGDWVLQPDGSLDRRALREYIFQNPQARHTLEQITHPAIRQSIIQQLQNPKSPYVILVSPLLFETNQHELVNHTLLIDASEQTQIQRASQRDGQNQEQIQKIIAAQMPRERKRELANDIVFNDGLLEHLYQQLEPLHQSYLKRAN

SEQ ID NO: 8082 - protein, 444 aa, Acinetobacter baumannii
DSICGENMSEHPQGQKHCSFCGKTQSEVGKLIAGEDAYICNECVDVCLDLVQTSQQVEAGDWASKALPKPHEIRAALDQYVIGQDLAKKTLSVAVYNHYKRLKVGQSGHVSKDVEIAKSNILLIGPTGSGKTLLAQTLARLLDVPFAMADATTLTEAGYVGEDVENIVQKLLQKADYDVEKAQKGIIYIDEIDKITRKSENPSITRDVSGEGVQQALLKMIEGTVASIPPQGGRKHPQQEFIQIDTSNILFICGGAFAGLEKIVQQRQEKGGIGFTADVKNKDETKKLAELFRQVEPTDLVKFGLIPEFIGRLPVIATLEELDEEALMQILTEPKNALTRQYQYLFNMENVDLVFEDSALRAVAKRALERNTGARGLRSILENVLLETMYDLPSRTDVGTVFINEAVINGEAEPVYKSERQPKEAVTHESVAKADLKVIDSKSA

SEQ ID NO: 8083 - protein, 180 aa, Acinetobacter baumannii
KSVCPRDRSQRYRQYLGSQMIDSEGFRPNVGIILANDDGQVLWAKRIGHNAWQFPQGGIQFGETPEQALFRELREEIGLLPEHVQIIAQTKGWLRYRLPHRYIRSDSDPVCIGQKQKWFLLKLTAPAKNIQLNLADPPEFDEWQWVSYWYPLGQVVNFKRDVYRKAMVELCTQLPVQQLP

SEQ ID NO: 8084 - protein, 376 aa, Acinetobacter baumannii
ISELDYMATSAKKNAKAKQENTSTSNIKKLIGLIDQLEEHIIKRHKFPYGLPSAYAEHYKAYLPEQMEPISEEMTDNDRKWFYEQLDQGLLKESPEQKALRQQAWRLPPPLLRGKSEIYIYIPEEDRLARHYGEIATEIRKFKNLVSTKTRIFKKTAQQAEKHFEEAFRLYSKHYDCSFYIYTLPEDIYKQIRQSQLARNSHKKSQRVKKTYLSLVQRFITSNQKTYSSMDTVLGAIEQQAISKIPEYLTQEYNAEIEHCLRKKEEAEYFLFAARNDLSTAEVKEIEEYGKKTVIIQAQNRDQPLTSFAGRPIERYKEIRVFYQKKISALETQKSKIRTDDQRMKLLNSAKSWLKESEPSLYDALNIFIEKKGRKL

SEQ ID NO: 8085 - protein, 261 aa, Acinetobacter baumannii
IEDCRMNQLPSTAVNSQENLDQMPIMNHLVVLRRHLFRIVGVTLFLFFCLLPFRNHTYQLLSEPLRLQLPASSSMIATDVTATFMAPFKLNLFVALMLAMPFILYEIWSFVRPALYQKERHLALPLLIGSIILFYAGVAFAYYITLPAILHFFISVSPETVAPMTDINSYLSFCLKLFLVFGVTFEIPIATLLLILIGVVNTQSLAEKRRFIIVGCFFVAMFITPPDAISMVMLAIPMWLLFEIGLLFGKILEKRKTHSAE

SEQ ID NO: 8086 - protein, 209 aa, Acinetobacter baumannii
SKSCSRFISFIHNKKLFYNGNYMPYSDLSFRALSVLHKSRYLFNKHGFHNVGVDRIVREAEVPKASFYNYFHSKERLIEMCLHFQKDVLKEQVRSIIYIQKDLILREKLKKVFFLHTSLDGYYHLLFRAIFEIEKLYPAAYQVVVQYRHWLTNEVYKLLLTVKKDATKSDSDMFLFTLDGAIIQLLDETRGDTRELLFTYILKGIFLKD

SEQ ID NO: 8087 - protein, 261 aa, Acinetobacter baumannii
PCSCGSFYRKTSTQTLQPTIATMNTESSAVEKQPSTSLKSSDGNQTTTVKKAAQSKTAQQKNVLSKNTPKKQKISAYKGPAPTGKYIVQRNESLWSIANRIAAQTKQPVAKVMRDIQAQNRHAFIQGDVNRLRQGSSLNLTANATKASHLKPKSTEANLAKPTSGRAKYRLQQAEMSIVAENSPNSAHGSAKKSTQQSQNNTELAVKVMTTRKKTVTLQRNVTKLNQTLSLKDQRIQLLNARLAELQQQLQAQQQTHKQKH

SEQ ID NO: 8088 - protein, 389 aa, Acinetobacter baumannii
IGPCSLAVLNPASVPLSLYIHMPWCVRKCPYCDFNSHAVPDGALSAELEQTYLKALVADFETQVELAQGRSIHSVFIGGGTPSLISAKGYAWLFEQLKSLLNFEDDCEITLEANPGTLEHDPFAGYLEAGINRLSIGVQTFNTDHLQKLGRIHSANNAMDAIEQARQAGFKRVNVDLMHGLPEQTLEQALYDLKTAVEQGATHISWYQLTIEPNTVFFRTQPVLPQDEVLEDIQEQGEAYLKANGFINYEVSAWRKEQPSAHNLNYWQFGDYLAIGAGAHGKVTRPDGVYRFQKTRLPKDYLAKVPAEHLQMKKIEADELPFEFMMNALRLNDGVKAELYELRTGLSLNDLNDVLTSLRSRKLLVEDSGRLACTEQGHIFLNSVLEEFL

SEQ ID NO: 8089 - protein, 418 aa, Acinetobacter baumannii
LFVCRYTMKSLNNTAKPILPPIAQFSVADRDAFLEQLKEDFSTHEYMTENGKIKIFKTSINPEVEKMLSRVEFIKYFEKERPIATLKSVQSFKGKEQLRVEYAKDIPLLLKCQLTTIFVSARSGNYKMGIELQAFKDSFLELSKEEQYTLYEFSLINQCYTSEQAQAYVAALIKFQKLFAIRMSSASIRKQLSNRASNRRRSKERCVELVETLLKIHSRILVVRVDLGLIRDPAKLQQLAISTDFAQAEHDSEFMQESFIRFYDASKHNQLKQALGYILRIEHTPTKGFHGHLYYFFNANDHREDITWGQYIAEKWRVATNNLGTAFICNMKKDEYRYRALGILEYTDHEMLKNLKATFDYICKNDQYFAFTNGEQIRSFRTSQIPKVPATKLGRPRKFEQLNLLDSDQSDDAQVGGQ

SEQ ID NO: 8090 - protein, 96 aa, Acinetobacter baumannii
ILKCILAFLLMVNEGWKMKILVRNLDRSVTEAEVLELFKAYGKVESCVVVTDKDTGKSKGFGFVEMPNPREAIKAIKGLNTLKVKGYGIRVKAAEE

SEQ ID NO: 8091 - protein, 61 aa, Acinetobacter baumannii
IIFLIYVYEKYIFNFKNRLLIMAQYKAGNAMDNYKIVFELIIKIHILCDLLDRPYCLFFYL

SEQ ID NO: 8092 - protein, 81 aa, Acinetobacter baumannii
KSLCHADLTQNNFQHNANIQRFSKLHNASFFKNRTKKNRSDLGATFYQLIFSRQTINQANVRTKYTSILKLQVRQYHTTIP

SEQ ID NO: 8093 - protein, 127 aa, Acinetobacter baumannii
LFMWKYLFSIFCLGANIHCYATDFGTTNNFVSPNLQLKQNVLPPTPKNIPLPAFGQRIIGWGTGAEGARQRLENIQPADVSMIKKQGTTLEMITAWQDFYEQEQQRNENNPTAKYRARLMKKIADLW

SEQ ID NO: 8094 - protein, 674 aa, Acinetobacter baumannii
PPPWPNGNVSMTKQALLEVSNLVREFPAGESTIQILKGIDLTIYEGELVAIVGQSGSGKSTLMNILGCLDRPTSGSYKVNGQETGKLEPDQLAQLRREYFGFIFQRYHLLGDLSAEGNVEVPAVYAGVTPADRKQRATALLTELGLGTKTQNRPSQLSGGQQQRVSIARALMNGGDVILADEPTGALDSHSGVEVMRILRELNAAGHTIILVTHDMQVAKNATRIIEISDGEIISDRPNVPDQSLEEVKSDPDAAPALQNKQKKGKSISAWRSTLDRLSEAFQMALLSMNAHRMRTFLTMLGIIIGIASVVTVVALGNGSQQQILSNISSLGTNTITVFQGRGFGDNSKTANFKTLVPADADALMTQPYVSAVSPMVSTSKTMRYQQNEANATINGVSNDYFDVKGLVFKDGQTFDQRSVRDRSQDVVIDTNTQKQFFSDGTNPIGQVVLLGSVPARIIGIVEPQTSGMGSDDTLNVYMPYTTVMSRMLGQAHVRNIVVRINDKYSTSAAENAIVNLLTQRHGAQDIFTMNSDSIRQTIEKTTSTMTLLVSAIAVISLVVGGIGVMNIMLVSVTERTQEIGVRMAVGARQSDILQQFLIEAILVCLIGGVLGVLLSLGLGQLINKFAGGNFAVAYSTTSIVAAFVCSTLIGVVFGFLPAKNAAKLDPVAALSRE

SEQ ID NO: 8095 - protein, 459 aa, Acinetobacter baumannii
KITCSRRNSCSIKKLQQGGSKDMNSIIQMDSEINQAYAGFGFFDIYHRDSFKLPARTTWIDGWKIEYMAIADPQTIHKTPIVIVGGAFQNFNSYKYCVEQLFESGPVILIDLPSMGANQQITNRDTGISAGTLELPDLSEMLGRWLDIVGIQKVSVMGMSLGSVVASCFAYHRPDLMDRMILMGVMQKTRKSWRMILEESLKLMQENRMEEFGQAVILYLVNHAKLDKTRMSPTAKKLFFRQMAEFTGTERERYEINCNRLLRLTDVPIPECKTLVAAGQYDSFTLPHENANFALQCPDMEFALIANADHVPQLQRRKETMSLFTSFLKGESIQNLDGIIPMTREQIQNMERRGEERIPVLQPKTKLSHRECETEVPVTIVDVTFFGMYLKLDDVAQLEFVNEHPRDLALHLEDEEGAFSIECLIFEATEQGVRALFKHGSFELADRLSRFIARQKQAA

SEQ ID NO: 8096 - protein, 587 aa, Acinetobacter baumannii
VDKCVDNLNNPEQSDLSWLTTWSTFLNQAPFTAQTQAPEAAYFLQQLIEASLQGDSCIEISPEQIETLGQLVISAEQAKSQVAPCVHDGQGLALYRYWNLEQRLAEQIRRLKQQPIQPVSCEEHLDLLTDPHQRAALQMVTRQSLSIITGGPGTGKTYTLARIIAVLSQAIPHIRVAMAAPTGKAAQRMQEALQNSFNDPKLLESGLMSDELRNQSTQTIHRLLGMGHSQTPRFNQKQPLPYDVIVVDEASMLDLNLATLLFEAVPESCRIILLGDANQLASVDVGAVLADLQQIEALSENRVHLQTSRRFAEGALIGQVARFIQMQTSQIDHEQVLQQFEIDIVQVSELRSIPLEADMPDVVQLEYLPEDSPITLETYYQKLMVGFQGYVQSLKAYIQDDRSLEHIENIVKSFDDYRILTAVRHGPFGLQQLNQYAERWLQQQLGIVTLGGWYVGRPVMMTYNDYQLGISNGDIGLCFEHRTQPQQFEVYFPSLNKWVAANRLPKSIQSAFALTIHKSQGSEFTHTAVVLDQAAKNLLSQELIYTAITRAKKVVSLLVDPEALLQSFTVRTTRKSGLVEKVNRLVR

SEQ ID NO: 8097 - protein, 207 aa, Acinetobacter baumannii
QLVRQSVLLMNTPTRPTLHIGHFMTIRPILKNLSISLCLSCITTSLFASPAKLSSVKELMQMSQIDYLLKESINELTPYYDQQAEQIISNITGIKTLGPKEKEAAKKLGLLLKDSSNQLISSPKTTQALQDIYLKTYTEEEIQANLKFLKTPEGQSITRKNVQIMGQISEYMMELGQQTFNDPKARDHMQEEMLKIIAPLMKDKEKS

SEQ ID NO: 8098 - protein, 79 aa, Acinetobacter baumannii
PSVRPTFVLAKVGKTILIHKTCSLLVCIKLYRRNSIFTDFGQVVDDVSASHINNVVPTINLKLLQPYLNKSLHIPLDVF

SEQ ID NO: 8099 - protein, 62 aa, Acinetobacter baumannii
VKLLELAWTAKFGSRNFWYLACSEAPNLFSISKGEVLIIFAYVVKRSLEILKHFMVGILQNA

SEQ ID NO: 8100 - protein, 144 aa, Acinetobacter baumannii
FNMLSYFLLFLSAFGAATLLPLQSEAVLAALLLKNQHSAFLLILIATFGNILGSCINWWLGLKIEQFKHKKWFPVSEKRLEQAQRFYHKYGFYSLLLSWTPVIGDPITLVAGLFKENFWRFLFMVLTAKAGRYIFIYWVITGFI

SEQ ID NO: 8101 - protein, 94 aa, Acinetobacter baumannii
YGMLIVSVLSAVPMHQRFSLKATLRSDLSDVYQFTFHNQLELVTYFFEQTELNATVCHFADIISLRRRHNSLGPVRAGDESIILIEVSIREISL

SEQ ID NO: 8102 - protein, 71 aa, Acinetobacter baumannii
EPDRMDETIKTPYQCITSASKRLGKYHGPEGFFGLSHERSVMSNPELYSLKYILPPFNKPIHRFISKTLLR

SEQ ID NO: 8103 - protein, 495 aa, Acinetobacter baumannii
LMGREILTVVETVSNEKGVSREAIFEALEQALVAATKKKFYEGTNSEEAQLRVEIDRRTGDYRTFRQWTVVADEDHEMPACQDAISDVDPAKWSIGDVRELEVESIEFGRIAAQIAKQVIVQKIREAERALVADAYESKVGELIYGEVKKQTKDGFIIDLGDNAEAYLAREEMIPKEILRPKQRVNAILYSVNREGRGAQLLLSRAKPEMLIALMKKEIPEISEEIIEIKAAARQPGVRAKIAVKTNDHRIDPVGACIGMRGTRIQAVQQELNGERIDVVVWSDDPAQYIASALEPADVSGIVLDEDAKSADIIFATNDQLARAIGSQGQNVRLASDLTGYKLDMMLEEQYRARQQNEAQQYLDMFVSRLDIEEDLAMALVEMGFTSLEEIAYVPAETFDEIELDAELVELLQSRAKEAALTDALKQQENIQEPSADLLNMEGMTSEIAYSLAARGIITVDDLADQATDDISDIEGLGHEKAGQLIMKARESWFN

SEQ ID NO: 8104 - protein, 223 aa, Acinetobacter baumannii
TTLRLIRSWIEMTAYNKLKIAIFTIMSSPSIYAITLDPIQIQSAPGELLYAEMNFQQADPNTPLQVSLATQDDLNGLGVTHQPPGNLNFYTRQNGQGSGVIVITSSRPIIDPELNIVVKVSEGNATRLQHIKTVLKPSPIKKAAMNESPLSPQFIVNEKDIALNLPESTQYTPTETTSTVAETTGNEHNLNISTGTAPALNSSSPAPVAPFTEKLRLKHFSQL

SEQ ID NO: 8105 - protein, 222 aa, Acinetobacter baumannii
HSSRSILVIKFGYLMSTPHWFDQGSLVLASNNKGKVAEFEKLFEQLKLPVEIIPQGRLNIPDAIEDGLSFIENAIIKARHASKISGKPAMADDSGICVPVLGGAPGIYSARYAGEHGDDSANNAKLLNDLLPFRKNGEAIEGMFVCVLALVTHAEDPLPQIFQGIWHGEILEAPRGENGFGYDPLFWLPELQVSSAELSKEDKNKISHRGQAMQLFRESLQK

SEQ ID NO: 8106 - protein, 151 aa, Acinetobacter baumannii
NRTRLMTATQSKSIMAFDFGTQKMGMAIGQSAIESANPLPLFVMKDGIPNWDQLLKIVKEWQPDLFIVGLPLNMDDSESELSTRARKFARRLRHQTNIETWMVDERLTTREAREELGFYQEQGRAKKLSADSFAAALLIQSWYRNPVGLTP

SEQ ID NO: 8107 - protein, 522 aa, Acinetobacter baumannii
FSPLANSPLKRFFGMTTIIKQDDLITSIKDALQFISYYHPQDFIQAMSRAYDREENKAAKDAIAQILINSRMCAEGHRPICQDTGIVNVFLEVGLDVKFDLTMSLDDAVNEGVRQGYLENSNVLRASVLADPAFGRKNTKDNTPAVIHYKLVPGNKVDITVAAKGGGSENKSKLAMLNPSDSIVDWVLKTVPTMGAGWCPPGMLGIGIGGTAEKAMMLAKEALMEEINMDELLRRGPENKIEELRIEIFEKVNALGIGAQGLGGLTTVLDIKIKDYPCHAAGKPVGMIPNCAATRHAHFQLDGSGVAHIQAPKLEDYPSVTWDASQSKRVNLDTITQEEMDSWKPGDTLLLSGTMYTGRDAAHKRMVEMIDNGEELPVDLKGKFIYYVGPVDPVRDEVVGPAGPTTATRMDKFTRKVLEHTGLFGMIGKADRGPTAIEAIKDNKATYLMAVGGAAYLVSKAVREAEVVAFADLGMEAIYKFVVEDMPVSVAVDVNGTSIHAVAPKIWQAKIGKIPVIDAAAG

SEQ ID NO: 8108 - protein, 139 aa, Acinetobacter baumannii
LVERWLEFMGNHPILFGTLGVLIVLFFIFEGQRNGRKISPQSLGILVKAKNALLIDLRDSKDFREGHISGSRNIPYSQIASHADELKASDRPLVFICNLGQVAGSALQKVAHHDSYRLDGGISNWKAQGLPLVKSKPKA

SEQ ID NO: 8109 - protein, 311 aa, Acinetobacter baumannii
INMRTTKKIYSKTLLSIALIGLSGLAFANNTDVQRTDNSIKSSQSESMKMLLKEPGGLGYVDRNTYQNSTSGNDGDNNAGLEVETSNSRNHDKHLKEHGGQVFQTTKFENEWTVDEDGKGTLGSKIETLIGTDENRLFIEANLDKVESHDPKYDVSALYSRNVAPFWDVQAGVRYSEDKNNSNSDRVDGVIGVLGLAPYFFETQAYLYGGENNFWGASLEVERDFLLTQKLITQPYLEVDTVFSDNSNYAAKSGLSELKTGIKTRYEVTKRIRPFVDIAYQYEKGQKATTMQEATESEKGWKYGAGIELVF

SEQ ID NO: 8110 - protein, 94 aa, Acinetobacter baumannii
TYALLIVRAHHHVLSVYEATPVFGIELPDLTDQQNTVFAWHIYRAACVPLRRYLSRFLLLRRTLLAAKSVQDEKDALVCAAQYKTDATPVLNKK

SEQ ID NO: 8111 - protein, 730 aa, Acinetobacter baumannii
HQLRNPPKLRRSGMIHAGNAITVQMLADGIAEFRFDLQGESVNKFNRATIEDFKAAIAAVKANNDIKGLVVTSGKSTFIVGADITEFGQNFAQGEKAIVDWLMPVHEIFNSFEDLDLPKVAAINGMALGGGFEMCLVCDYRVMSEAAQVGLPEIKLGIYPGFGGSVRLSRLIGIDNAVEWMAMATPKKPAAALKDGAVDAVVAADKLLDAATDLVKQAISGRLNWKAKRQEKLEAVKLNPLEQMMAFNTAKGAVLAKANPAQYPAPKLLLDSLQAGASLARDEALKAEAEGFAKAAVTPQAEALIGLFINDQVVKKASKQHEKGAHPVNQAAVLGAGIMGGGIAYQAASKGTPIIMKDIGNPQLALGMKEANNLLTKQVERKKMKPVQMGETLARIRPTLSYEEFKEVDIVIEAVTENPKVKEIVLAETEKNVRENTIIASNTSTISITRLAKALQRPENFVGMHFFNPVHMMPLVEVIRGEKTSEEAIATTVVLAQKMGKTPIVVNDCPGFLVNRVLFPYFGAFDLLVKDGADFQQIDNVMSKFGWPMGPAYLIDVVGIDTGVHGAEVMAEGFPDRMKPDYKGAIEAMYEAKRLGQKNDVGFYKYELDKKGKKAKTVDPTAYEVIAPFVTGEKREFDNQEIIDRMMLALCNETVRCLEDNIVATASEADMAMIMGIGFPPFRGGPCRYIDQTGVAEYVALCDKYAHLGKAYEAPQMLRDMAANNKKFYG

SEQ ID NO: 8112 - protein, 705 aa, Acinetobacter baumannii
NKIRKIQYMSMFNIVRKEFQFGQHQVVLETGRVARQANTVLITMGGVTVLVAVVAAPTAKAGQDFFPLTVNYQEKQYAAGRIPGGYGKREGRASEAETLISRLIDRPIRPLFPEGYYNEIQVTATVVSSDKTMEADIAAMLGTSAALAIAGTPFRGPIGAARVGLINGEYVLNPNFEQMAQSDLDLVVAGTESAVLMVESEAKELSEDQMLGAVLFGHDEMQIAIQAINEFAAAAGAKPSDWVAPAHNEELRAKLKEAFEAKISEAYTIAVKQDRYAALDALHAEAVAQFVPEEDVDGIADEVDYLFEDLKYRTVRDNILSGKPRIDGRDTKTVRALDVQVGVLERAHGSALFTRGETQALVTTTLGNTRDALMVDTLAGTKTDNFMLHYNFPAYSVGETGRESGPKRREIGHGRLARRGVQAVLPAADRFPYVIRIVSDITESNGSSSMASVCGASLSLMDAGVPLKAPVAGIAMGLVKEGERFAVLSDILGDEDHLGDMDFKVAGSANGITALQMDIKIEGITEEIMEVALNQAFAGRMHILNEMNKVISRARPEISMHAPTFEVITINPDKIRDVIGKGGATIRQITEETKAAIDIEDNGTVRVFGETKAAAKAAIAKIQAITAEVEPGKIYDGKVIRIVEFGAFVNIMPGTDGLLHISQISNERIANVTDVLKEGQEVKVQVQDVDNRGRIKLTMKDIEQA

SEQ ID NO: 8113 - protein, 72 aa, Acinetobacter baumannii
QIYRYCLEIVELSIRVFIFGIFLIEPLKKPVQYKQAFTNELNSLCQFLFFNKLDISNLCIPKLSPQCTIIKT

SEQ ID NO: 8114 - protein, 317 aa, Acinetobacter baumannii
MQSRHSRLIILGSGPAGYSAAVYAARANLKPTLIAGLQLGGQLTTTTEVDNWPGDPEGLTGPALMDRMQAHAERFGTELVYDHINEVDLNVRPFVLKGDMEEYTCDALIIATGATAQYLGLESEQNFMGQGVSACATCDGFFYKNQKVMVVGGGNTAVEEALYLSNIASHVTLVHRRDSLRSEKILQDHLFVKEKEGKISIIWNHEVEEVLGDNTGVTSVRLKSTQDESKQDVEVHGLFVAIGYKPNTGMFDGQLNLRDGYIQVQSGTSGNATATSVAGVFAAGDVADSIYRQAITSAGSGCMAALDAEKYLDQLND

SEQ ID NO: 8115 - protein, 726 aa, Acinetobacter baumannii
ILPRENIIMSNESKCPFSGHNSKPQVTVGGGTANLHWWPNQLRVDLLNQHSERSNPLDKDFNYRQEFKKLDYYALKADIKNVLTDSQDWWPADWGNYTGLFIRLAWHAAGTYRMGDGRGGAGRGQQRFAPLNSWPDNASLDKARRLLWPVKQKYGQKISWADLFILAGNIALESSGFRTFGFGAGREDVWEPDNDVNWGDEKEWLAHRNSEALAGSNLAATEMGLIYVNPEGPQASGDPRSAAPFIRATFGNMAMDDEEIVALIAGGHTLGKTHGAAPADHVQADPEGAPIEQMGFGWANSYGTGVGKDAITSGLEVIWSQTPTQWSNYFFENLFKYEWVQERSPAGAIQWVAADAEAIIPDPFDPSIKRKPTMLTTDLTLRFDPEFEKISRRFLNDPQAFANAFARAWFKLTHRDMGPKARYLGPEVPAEDLIWQDPLPAASATPSSASIADAKAKIVALGLSAGELVSLAWASASTFRGGDKRGGANGARIALSPQREWEVNKKAVETLTKIEELKASTQLSLADLIVLAGNVGVEQAAQAAGFNITVPFAPGRVDALQSQTDVESFQLLLGLADGFRNWKKQGVNTPAEVLLIDKAQQLTLTAPELTALIGGLRVLGTNWDGSQHGVFTQQVGVLSTDFFTNLLDMSNVWAPVDSTSEVFEGKDRKSGTVKFTATRNDLVFGSNSILRALAEVYAQADGKEKFVQDFVAAWTKVMNLDRFDLA

SEQ ID NO: 8116 - protein, 303 aa, Acinetobacter baumannii
NTRLIKILSQLSDINQMNMTTANTARLLITCEDKPGIVQAVSSFLYHQGANITALDQYATEAQGGRYFMRVEFELDHLQSRKDALIQTFAANVAERYGMQWRLAFVNDIKKVGILVSKVDHALLELLWRHARGSLPCEITHVISNHEDLREAVENFGIPFTVIKVTKDNKAEAYAQIHEMMQGNDLLVLARYMQILSEDFVSKWEMKIINIHHSFLPAFVGANPYKQAYEKGVKLIGATAHYVTADLDQGPIIEQDVERVSHDYNVEQLRELGEDVERNVLARAVKWHLEDRIIVDGNKTVVF

SEQ ID NO: 8117 - protein, 310 aa, Acinetobacter baumannii
FLCSLDMSPRTQGYFFVLVTMCIWGGFTLFARLNAQWHISAWDIAALRFAIAFLILMPILIYKKDLAFLWSKHAVILALIGGVIYCLTVYTAFLYAPAAHAAIFLNGCIPICTAIAAYILFRQPFDKHTWVSLAIMITALALMSALMLQSSTSAFGIGDLLLFISAIWWGIFTVLLKQWKLSAWHSMASVAIWSAIIYLPIYLLFLPKHFMDVDPLHLAVQSIFHGVFVVIIATLTYVAAIQRLGAFKTGSIVTLAPFIAAILAIPLLGESLSPSIVVGLVGMGIGALQPWRWFRQDSLTQKIKQQNTQN

SEQ ID NO: 8118 - protein, 268 aa, Acinetobacter baumannii
KVSSMSGSTITPWVVGNWKMNPMRANANQLIEEFKQLLQQNQIADENCHVGVAPVSIALTTVQAQLQDAARTVHTVAQDVSRVAGTGAYTGEVSAELLKDSQINFVLVGHSERRDIFGDNVEILKAKLQNALNAGMTVIYCVGESLEQREQGQAEQVVLQQICDIAPVVTAEQWQNQVVIAYEPIWAIGTGKTVSPQDAQAMHAKIREGLCQLTPAGSNIAILYGGSVKAENAVELAACPDINGALVGGASLNAASFYQIVQAFAQSK

SEQ ID NO: 8119 - protein, 375 aa, Acinetobacter baumannii
HHGSHNAVLSLKMENFMSKQILILAGDGIGPEIVGAAEKVLNKVNEKFNLSLTWEHGLLGGAAIDAHGEPYPAVTSEQAKKADAILLGAVGGPKWDTIERSIRPERGLLKIRSELNLFANLRPAILYPQLADASSLKPEIVAGLDILIVRELTGGIYFGQPRGIRELENGEKQGYNTDVYSESEIKRIAKVAFELAGLRGGKVCSVDKANVLEVTELWKQTVTDLQQANYPNIQLSHMYVDNAAMQLVRAPKQFDVIVTGNLFGDILSDEAAMLTGSIGMLPSASLDENGKGMYEPCHGSAPDIAGQNVANPLATILSVAMMLRYTFREEAAAKAIEDAVGQVLDQGLRTADIMSEGMTKVGTAEMGEAVVAALA

SEQ ID NO: 8120 - protein, 930 aa, Acinetobacter baumannii
FSLRNCSMPPFVLVDGSYFLFRAYHALPPLTTSTGLHTNAIRGAISAIQKLMRRMQPTHMAVIFDTPEPTFRHKLSPIYKGDRPTMPEELSQQIPYLHALIKAQGIPLYSLPGAEADDIIGTLAKRAVKEGHHVLISTGDKDMAQLVNDYVKLEDSFKDRVLDTDGVFEKFGVWPNQIIDYLTLMGDASDGIMGVPGVGAKTAAKLLTEYGTLDNIIANVDQLKGKLSQNIKDNLDNIKLDHQLASIVCDLPLELDWHELKLTDPNVDALRNLYTELEFRNQLQSLDHPNNPNSSSYKQQASQTIVQNEVKPAQTIETEDQASLTSQDDQLGTANYHTVLTQEAWDQLWQRMQNADHFAIDTETTSLDYRIAEMVGFSIAFDAKDAYYVPLAHNYENAPQQLNREQVLAQIKPVLENEAVKKIGHHLKYDAHIFANHGIELKGWYFDSMLASYVLNAAATRHGMDDVARVYLSHLTTTFEQIAGKGAKQKTFNQIEIEVAAHYAAEDAHVTYRLYEVLSNKLKAHPELENILYNIEMPVARILSGMEEDGIRLDHAFLDKLSVEFAKTMEDLENQAMEIAGETFNIASPKQVGEILFDKLGIKGGKKTATGQYSTSESVLEKIEHPLTEIILEHRGLAKLKSTYTDRLIEQSHNDTHRVHTSYHQALTATGRLSSSDPNLQNIPIRRQIGRQIRKAFIAPEGRVLLAADYSQIELRLMAHFSQDDALVHAFQHGQDVHRRTAAEVLGIAIEDVTNDQRRQAKAVNFGLLYGMSEFGLIRQLGFTREESQNYIKQYFQRYPGIYEYMQRTRQVASEQGFVETILGRRLYTPDIDARNVMVRKAAERAAINAPLQGSAADIIKLAMIEVDKILPKDQAKLLLQVHDELVFEVDSNIADELSKQIADIMQSVLEISVPLVVEVGQGKNWDDAH

SEQ ID NO: 8121 - protein, 111 aa, Acinetobacter baumannii
AWLRRFLMVETITIFVLAIFVGYYVVWGVTPALHTPLMAVTNALSSIIVVGAMLQTVGLPVLGVDANVAFQSVNVVSVLGAIAVFLASINIFGGFAVTARMLEMFKPKQKK

SEQ ID NO: 8122 - protein, 100 aa, Acinetobacter baumannii
KSLSSMTTSLDKMMKNKILMGLVGVSILLVTGCSSDFEKGMKQSCRNTGGSRSFCSCFYDRMEEHYGEEKLEAIGMMQVKMPEDFEEVSFKSGQQCAHKL

SEQ ID NO: 8123 - protein, 238 aa, Acinetobacter baumannii
RTIRREKMSRSIRLLNLLQQLRESRYPVTAQVLAERLGISIRSIYRDIDSLRAQGVRIDASAGLGFQLKEDILLPPVTFNENEAEALFLALEWLKDVPDQAMKSAAVSIYSKLYAVLPEHRKYLIDDMTLGVTHYWHPVDEALVEQVRLAIRKQVKIKVDYCDEHKRISQRSLWPFALGYLHDKVVLAAWCELRQAFRHFRIDRIHNLQMSEEIYPEFKKHLFQRWWKQEMQRTTDKN

SEQ ID NO: 8124 - protein, 443 aa, Acinetobacter baumannii
YAISKDMTMGTSMSGCGCNKESSCEDTKQNQNESETNSGNSKDLTAEESKSSCCGNEVPQQSKPDEKDPCSSTQPCSTQSNSCCTPDSISSPETVSDNEDVATFISDYKIPKMDCSAEEQMVRMTLSSLVNVKRLVFDLPNRNLKVMHNGESNEITAKLEALGFGAKLNKTEAYVNKEHANEISTFLIPKMDCSAEEQMVRMALSPVNEVKGLTFDLPNRKLKVFHNDGLNEITSKLEALGFGAKLESTATSVGEMPEKADTSEQAKVLKILLAINAALFVIEFISGLIAASTGLIADSLDMFADAAVYGIALYAVGKAAKYQVKAAHFAGWIQLFLAITVIVDVIRRFILGSEPESLLMIVIGFFALIANVACLYLISGHKDGGAHMKASWIFSANDVIVNLGVIIAGFLVALTGSAYPDLVIGIIVSLFVLNGARKILALK

SEQ ID NO: 8125 - protein, 170 aa, Acinetobacter baumannii
FEPSYFWADTMTVTTYIGLGSNLRDSRQILSEAITKLKSLGEVKVSKLYQSPPMGPQDQPNYLNALAQLKTELLPLELLDQLQRFEHEAGRVRLRHWGERTLDLDLLIYGNEKIQNERLTVPHVGILQRDFVVIPLLDLDAGLHINDQPLKNLELIQQPTLTVLADESWA

SEQ ID NO: 8126 - protein, 70 aa, Acinetobacter baumannii
LNQRSYYVPCSLISECKKATSSCGFFIAFFIHLIDWFYIPPFGIHAIFLAANGFFLALSVNDTARLRYFY

SEQ ID NO: 8127 - protein, 136 aa, Acinetobacter baumannii
KRKRSLSAIGRSLCFIRTSFISLGSKIMTTIHYREIVCDGHTFSAEVVDEQCTFDLQQFAQACGQSPDWILQLIEYDILAIDTPPEKHQFMGEDVIRARKAYRLQRDFDASLAAVAVMLDLIDEVQQLRKQLKHFH

SEQ ID NO: 8128 - protein, 71 aa, Acinetobacter baumannii
SYRRKSPYASIKQSKRQNTYCYVNTSYSLLDSDGFMLKCENSICSSLLCQNNLFHLLYNLIRVVYVVRNLS

SEQ ID NO: 8129 - protein, 468 aa, Acinetobacter baumannii
TMRSTLSTFNEVWQRKFRHGVLKQAQEFSEKSSFLIGCSGGMDSMLLLHLMAQIFPQKIRAIYIDHQLQDQSAEWAEVVATQATILNIPYIIQKVQIANGNLEAQARQARYQAYQQHLQENEILLLAHHQQDQAETVILRLLSGAGVDGLAAMQAIDYRKDMTIWRPFLDLTREQIALWTAQLEVKYIDDPMNYDNHYDRVWCREALWPFLTSRFPKMQQALSRTSYLMQDASEILEEVLKDDWQYSGSADYLDLTKLSELSFARQRQLLSAWMKGQGQYRPAFEMVERLRAEVIESKSDAQAALHWNQFYYVRYQNILYRLSKQIYFAETLNPVDAELEHSFKLEERWQGAAGLFHVECKKIGLSHSLLNKKLKIIRRQGGEKIHLYGRVGQWPLKKAIQEAHILPWLRHTIQILVLDNVMLGVFTPKGFWLAQSPYCEEGGWQPDLISHSCNLVNGEYSYGNSSEL

SEQ ID NO: 8130 - protein, 172 aa, Acinetobacter baumannii
HEGSELKPLNDTDIRIASFKDALSIAEVHVQSWKETYTGMIKREILDELNVLDKQQLWKEISRSPDHKLFIYTENGVVKGFLDGYLNPENNIAEIRAFYLLGEIQRKGVGRALFQKFYQCALNQGYAFIRLEVFNKNPSRFFYEKMGAKLTGEAELPEFGLGIIELFYEWQL

SEQ ID NO: 8131 - protein, 195 aa, Acinetobacter baumannii
GLLSLRWHYVIIFLSFSENGIYMSTGHVEYASLNGTHIFKLIGEVRAHSCISLDKLLNRIEQQENVVGAIVDLTQTTFIDSTVLGILAKLGLKLKQTHHIQAVMLSTNPDITTLANSMGLGQVFVILNYCGDPNVCTLTLTDEHITHNAMLRTVLDAHKTLMKLNANNQNMFEPLVKQLQKEQDTLEQVSDKQNA

SEQ ID NO: 8132 - protein, 1380 aa, Acinetobacter baumannii
FLLSPFCRRAWFTFRGLQMAYSYTEKKRIRKNFGKLPQVMDAPYLLSIQVDSYRTFLQDGKSPKNREDIGLQAAFRSVFPIESYSGNAALEFVEYSLGKPEFDVRECILRGSTYAAPMRVKIRLIIKDRETKSIKDVREQEVYMGEIPLMTENGTFVINGTERVIVSQLHRSPGVFFDHDKGKTHSSGKVLYSARIIPYRGSWLDFEFDAKDLVYVRIDRRRKLLATVVLRALGYNNEQILNLFYEKVPVYLDMGSYQIDLVPERLRGEMAQFDITDNEGKVIVEQGKRINARHVRQMEAAGLTKLSVPDEYLYERITAEDITLRDGEVIAANTLLSHEVMVKLAEGGVKQFNILFTNDIDRGSFVADTLRADLTRDREEALVEIYKVMRPGEPPTKEAAENLFNNLFFSSERYDLSPVGRMKFNRRLGRPYEVGTDQKSREVEGILSHEDIIDVLRTLVEIRNGKGEVDDIDHLGNRRVRSVGEMTENQFRVGLVRVERAVKERLSQAETDNLSPQDLINAKPVAAAIKEFFGSSQLSQFMDQNNPLSEITHKRRVSALGPGGLTRERAGFEVRDVHQTHYGRVCPIETPEGPNIGLINSLSVYAKANDFGFLETPYRKVVDGRVTDDVEYLSAIEEVGTVIAQADSAVDKDGNLTEEFVSVRHQGEFVRMPPEKVTHMDVSAQQVVSVAASLIPFLEHDDANRALMGSNMQRQAVPTLRADKPLVGTGMEANVARDSGVCVIANRGGVIEYVDASRIVIRVNEDEMVAGEAGVDIYNLIKYTRSNQNTCINQNVIVNLGDKVARGDILADGPSTDMGELALGQNMRVAFMTWNGYNYEDSILLSERVLQEDRLTSIHIQELSCVARDTKLGAEEITADIPNVGEAALSKLDESGIVYIGAEVTAGDILVGKVTPKGETQLTPEEKLLRAIFGEKAADVKDSSLRVPSGTKGTVIDVQVFTRDGLEKDDRALAIEKAQLDSYRKDLKEEYKIFEEAARERVIRLLKGQESNGGGSTKRGDKLSEDLLSGLELVDLLEIQPADEAIAERLTQIQVFLKEKSAEIDEKFAEKKRKLATGDELTTGVLKVVKVYLAVKRRIQPGDKMAGRHGNKGVVSNILPVEDMPHDANGVPVDIVLNPLGVPSRMNVGQILETHLGMAAKGLGDKIEKMLKEQRTVLELREFLDKIYNKVGGEQEDLDSLTDEEILALAGNLRAGVPLATPVFDGAEESQIKDLLELADISRTGQTVLFDGRTGEQFDRPVTVGYMYMLKLNHLVDDKMHARSTGSYSLVTQQPLGGKAQFGGQRFGEMEVWALEAYGAAYTLQEMLTVKSDDVEGRTRIYKNIVDGNHYMDPGMPESFNVLTKEIRSLGINIELKNGD

SEQ ID NO: 8133 - protein, 130 aa, Acinetobacter baumannii
AQLSRGVALMKKMMMIAGVGLMSTTLFVGCQNASPESKRIGSAAIGGGAGGAVGKHIGGNIGAGLGAALGAGVAANAKGSSSKTVRNSAIGAGVGAILGGAVIGGDAGAAAGGALGGSAGAAYEEKKGKY

SEQ ID NO: 8134 - protein, 253 aa, Acinetobacter baumannii
ILMSQSSAALNSPNPMKKKVITALIAVAIGHIGVLWAVSHIKPAELKPIEKKPLQVRFVKIQEQPKPLPPKPKEPPKKPEPKKEVKEVKVVEKPVTPPKKVEKIQQVKKAETPKETVKTEPKVEPKIVTPTTTVTEKVVEKPKPVVQEAPKAQPAPDPSPKRVSIGGSGVQWSRSPRLTVSPKDLQGEARSVVVLIEADEKGKITNVRVTRSSGIPSLDDKVVRAVRSAKFKPYMENGVAYPIKAEQPFDLTP

SEQ ID NO: 8135 - protein, 432 aa, Acinetobacter baumannii
FIMSSIVAIKGFNDVLPTQTAAWRRLEQHLASLMDAYGYQQIRLPIVEQTGLFKRAIGDATDIVEKEMYTFFDKGNPPESLTLRPEGTAGCVRALVEHNLLRGATPRVWYMGPMFRYEKPQKGRYRQFHQFGVETFGVATPDIDAELIMLTARLWKRMGVDHMVQLELNTLGETDERTEYRNALVAFLNEHKDALDEDSQRRLTTNPLRILDSKIESTQKILENAPKLHDFLKEDSLSHFQQLQDYLTAAGIKFVINQKLVRGLDYYNKTVFEWTTTALGSQGTVCAGGRYDGLVGQLKGKADQSVPAVGFAMGMERLLLLLEQVEQAEIVRDCEAFLVAEPAYQSKALVLAEQLRDQLEAANSNIRIKTGSQGSMKSQMKKADQAGAVYAIILGEREWEAQQLAVKELATAEQSQVALAELVPFLIEKFTK

SEQ ID NO: 8136 - protein, 412 aa, Acinetobacter baumannii
IHMSSAVVVSSENLDGQQQSSSTPASPAAEKVNLLGMSRAELEKFFEDIGEKKFRAGQVMKWIHQYFVTDFAEMTNISGKLRAKLEQICEIKAPEVVHRHYSKDGTRKWVFRVGEGSGSLVETVLIPAEDKTGSRKTLCISSQVGCALDCSFCSTGKQGFQRDLTPDEIIGQLWMANYSYMEEVPVAERERSVTNVVMMGMGEPLLNYDAVLSSMHIMLDDFAYGMSKRRVTLSTSGVVPKIDQLAKDIDVALAISLHAPNDELRNELVPINKKYPLAQLIAACQRYIAKDGNESARKHVTIEYVMLEGVNDQPEHAQQLLKLLKNLPSKINLIPFNPFPHAPYGRSSRNRIISFQKTLSDAGFVCTIRQTRGDDIDAACGQLVGQVADRTRRAEQWQKKVAQRQEILRTQG

SEQ ID NO: 8137 - protein, 197 aa, Acinetobacter baumannii
TMKRNVTHSFLLSLCAITLSACQSTYNVVDTVRIKQAEQENLGQNAAIYCSGAKSCEFERLNDITVVDAQTRRISNQAIHQGIVRLNGSVLSQSNSLYLSVPAKQYEVVIRYYPISPDRAETIHVIHQFKANHRYMFKMYRDKSNRSGSLLNVSVPDPLCVDLEQDGRVIRRFCRPFDVTTGLGEFLEQKKLTPRQS

SEQ ID NO: 8138 - protein, 95 aa, Acinetobacter baumannii
ASRRNRMALTNADRAEIIAKFARAENDTGSPEVQVALLTAQINDLQGHFKAHKHDHHSRRGLIRMVNQRRKLLDYLNGKDHERYTALIGALGLRR

SEQ ID NO: 8139 - protein, 326 aa, Acinetobacter baumannii
KKSGNLNYYLVKIANLLVKKTNIRKLNFYHANIDKSFIMNFDRNTPIAFLGIGLMGSRMASRLIQAGFQVAVWNRTTSACEELIDIGAHALDLSNIGQYPLILTCLADDKAVQAVFDQIQTNLKAGQVIVDFSSLSVAATKALAQAAASQDVIWIDSPVSGGTTGAEQGTLVIFAGGDAQTIEALSPVYNVLSQRVTRMGDTGTGQATKICNQLIVAANSALIAEAVALADRAGVDTTLLAPALAGGFADSKPFQILAPRMATHTFEPVQWKVQTLLKDLNNAVTLANNVNLDIPVAQKALLQLQTHQKNGFAEKDLATMIQVVEQ

SEQ ID NO: 8140 - protein, 119 aa, Acinetobacter baumannii
IWYGQYNPSVGKHLSSDIEGLMTALTKADMADHLSELTSLNRREAKQMVELFFDEISQALIAGEQVKLSGFGNFELRDKRERPGRNPKTGEEIPISARRVVTFRAGQKFRQRVGNEQID

SEQ ID NO: 8141 - protein, 194 aa, Acinetobacter baumannii
FYNGAVFSKTWLAEVGFTMAHAHHAAHAYVHHIKVRKEESSQGDLKTKAMLSKASSGNKKLHRPVSKRHKSEDQNIDLHKFSSKLESMSAKHSKEKCAKNIRIALQAAGADVSKHPVAASDWGQTLEKNGYKKIKPAFNRPQEGDIYIIERTSGHTYGHIAGYTGNGWFSDFRQKTYAVYKEKDVKYSYYRLDS

SEQ ID NO: 8142 - protein, 198 aa, Acinetobacter baumannii
CFYGTLERTFMSSTLNTRLIWIDLEMTGLDTDNDQIIEIATIITDDHLNVLAEGPVLAIHQPDRILNAMDEWNTRQHGQSGLIERVRRSKLTARDAELQTLEFLKKWVNPKVSPMCGNSICQDRRFLHRLMPELEQYFHYRNLDVSTVKELSKRWRPEIMSGLKKNASHLAMDDIRDSISELKYYREYFFIMNTDGKD

SEQ ID NO: 8143 - protein, 268 aa, Acinetobacter baumannii
KISGNFMALLRIEKNNGIATVYLNRPDKRNAMSFALLKELVTTAKAIQKDRDIRCVILTGEAQVFSAGIDLSDLNNPKNSAFAIWELVKPGQSLFQKAFLIWQNLPVPVIAALEGYCFGAGMQLALAADIRIAHPDTKMSIMESRWGLVPDMGLTRSLKGLIGVDLAKELTLTARVFDGNYAKDIGLVTHLSENPLEKANAIASEMLQRSPDALTAAKRVLDAMEHQPEKSLRLEKIWQLKLLLGKNSKLARKKDKHPEVKFLPRQYR

SEQ ID NO: 8144 - protein, 175 aa, Acinetobacter baumannii
ITLGGFTMALLIEDKKQIVAEVSEVASKAFAAVVADYQGLSVEQLTTLRVEARKLGVTTRIVRNTLAKRAFQGTQFDILNDNLVGPTILGFSTSEDDMGAAARLFEEFAKTNKAFELKAAAFDGKVYQGADVSVIANLPNQEKALTMLASVLQAPISKLGRLITALKEKNESEAA

SEQ ID NO: 8145 - protein, 519 aa, Acinetobacter baumannii
ITLGVNCYGFSSIMSDFLIDEELLAAIDMGSNSFHLAIARVDHGEVKKVASMSEKVQLAAGLDENKNLTEAAQQRGLACLARFVGRLGSVQPNRLRIVATNALRQAKNGHEFIQKAAEILPKPIEIIAGREEARLIYLGVSHTMANGGRRLVVDIGGGSTEFIIGEEFEPIYTESLQMGCVAYTKAYFADGEITQKAFDKAVVAARKELSAIATTYKMEGWDTVVGSSGTIKACRQIMVNMGLSDEQENVTREGLHKLKDRLLKFKNISEIDFEGLREDRRAVLPAGLAILYAVFEVLEIERLAYSDGALREGVMYDLLGRFKHEDIRDRSVQALMGRYNADPKQAERVVNTAQYLFDSVAKPLNLTSEDSDLLRRAAYLHEIGLAISHGGYHRHGAYLLQHSDIPGFSQIDQNHLSHLVAHHRRKLRNDVKNEVLKAGGHKLVYLSLLLRLAVLLNHSRSDQMLPAIELTIINDQQWQLSVSGDAKQWPLLVADLHDEQEQFKHWDIELNIQSEKFID

SEQ ID NO: 8146 - protein, 151 aa, Acinetobacter baumannii
YIKGPSFMTTSLDVKIYHNPACGTSRNTLALIRNTGIEPTVIEYLITPPSHDELVKLIQDANLTVREAIRQNVDPYRDLQLDRSDLSDEQLLSFMLEHPILINRPFVVTELGTRLSRPSEAVLDILPLPQKGAFTKEDGEQVIDENGQRVN

SEQ ID NO: 8147 - protein, 102 aa, Acinetobacter baumannii
CQKGYCKMAKARHSSFDCSPGCSVEAAISLIDGKWKCVILWHLLNEGTLRFNEIRKRVPSITQRMLTNQLRELEQDGIIHREVYPQVPPKVEYCLTEFRARA

SEQ ID NO: 8148 - protein, 297 aa, Acinetobacter baumannii
RARGESVALLLPILAFITGLLLAQTSISETIKPILSAWLARLLIPIVIIYNMVFYQSGSLSLMLFSFGSAFIIFFAYLALFKDRLLALCVSYTNMGWLGFPFAMALFGPEATAPIVALYIGMSLFGNAWAVTAVTTAPQSKLNILKKVLTSPPCISIFCAVVLRLLGAQHIESPAIHWVYEVAKFAMTFAGMCVLGMWLRRTRVYIKDLIYSTKAQAFKVACGFVLCGLSYRFLPIPNINQHIGVMFLMFCLPPAANIVALETHYQGTGRSAAYIASGTIVSCVCIAIYAVFLHLFV

SEQ ID NO: 8149 - protein, 258 aa, Acinetobacter baumannii
FLWGKRMWKNIRILCLLIVLLIVAVQAWRDQNQDWNQPIVVVLHPINADGLQTTQTYIHQLQNTDFQALKSYLSEWSQHYRGQSANFEIRLGQQLQQRPPEVPQNAGIFHVVWWSLKFRFYAWRQQQPEDNGASLKLYLNYYDPNYQKVLVHSTALEKGRIGSVNLFATRGQASQNQVVIVHELLHGFGAKDKYDLKTGQPIYPLGYAQPEKVPLYPQKRAEIMGGRTPLSEQTSKMPSDLQETVIGLPTAQEVGWLK

SEQ ID NO: 8150 - protein, 209 aa, Acinetobacter baumannii
AARGDCMTLDLFSPEPCSNLLPYDGEVQDYGCILTAEEAEQYFHYLYQHLAWRHDEAKLYGKHFITPRKVAWYGDEHYRYKYSGVFRDSLPWDKALAQLKQQVEQILSEKFNSCLANLYEDGTQGMAWHSDSDVSLARTTTIASLSFGATRKFSFRHIQTKEKVEMWLQPGQLIVMRGETQQYWQHRLNRSTKILQPRINLTFRQFKFS

SEQ ID NO: 8151 - protein, 358 aa, Acinetobacter baumannii
KIIFWSPMHNIGTREFIIALLFGALHSLFTLFIVLSSIWVCLALWVQQPFGWLGSRIIIGIWIAFALSMAGLYFNGHIISRRTDVLIYLLAFACSLVWYFSITARQDRDWNPEVANMLSYEKHGDVITLHNVRNFNWHPDGTYDVRWETRTFDLNQLNGINIITSYWMGPQIAHTLVSFEFKNQQPLVFSIEIRKEKTEEFSAIGGFFRKYELSLIASDEKDIVYTRSNIRKEQVYNFPVNMPRSEQKALFLEYLKKADELRAEPKWYNTLTSNCTTLIFDMVQAINPYQLPKDYRLIASGYLPNYLYDLKALDQNISLKQWYQIAHINPRTEHFEQFADQSSEHFSQIVRQGLPKVK

SEQ ID NO: 8152 - protein, 177 aa, Acinetobacter baumannii
MAILEQESLVMSRVARYHADRTNQKLYFARLACQQAEQTDHVQQVQAYREAAVFHLHGAMLAFLQELVRYYRLNDLQPTLKSIEEHMAAKGQVSPEVSVLQQLAKDGFVAELKRAYRMCQYAPEPTEPTPEEETSSNLIIKVTQGPQSWLPDVKILREWHRELSHLIDGFRNEMVEF

SEQ ID NO: 8153 - protein, 451 aa, Acinetobacter baumannii
LIFIEEAMQVTTEAVSGVARRLNVSVPTSRINEQFEARLKRTAKTVKINGFRPGKVPANVVRREYGASIYQEVVNDIIRDSVFEAIQQEKINAVGMPNIEKVEHKEDALVFEATVEVYPEVEVKAFDGLEVERKTAEIKDADVDTMIENLQKQRQTWAVTKGMAKKDMQVTFDFEGSIDGEKFEGGSAEDFKLVLGSGRMIPGFEDGIIGMKAGEEKVIDVTFPEDYQAENLAGKAAQFKITVKQVEKPKLPEIDAEFLKIFGVSEEEGIEKLKADVRKNMEREVRNGLRNQVKQAAFDALVAANEIEVPAAMVAQEIDRQRQQMVQQFTQQFGGAGAQSFDKSMLPDELFKEQAERSVKLGVLVSKVLADAKLEVDQARVDAYIDDMASSYEDPTEVIEYFKNDAQQRAQIEAVVLEDQVVDHILASAKVTDKAVSYEDLLKEQQARRMG

SEQ ID NO: 8154 - protein, 226 aa, Acinetobacter baumannii
HVFIFQNGTCSMIRKLILLVIFGLMSFVTNAKTLELQEKNMRQIFVLHGYSASINDHWFLDLKHQIEDENTTVTLIPFPDSEHPDVDAWQKVLDEQIPAVNENTYFVAHSLGVITLLHFLQRHNYQNIGGMILVSGFSGPISDSSPLSPYITKSKVDTNYFRDIEKKLVYLSDNDDLVPPQLTIQLAKDIDAPYITVPNGGHFLGREGYTEFPQLVDSLKEILESE

SEQ ID NO: 8155 - protein, 308 aa, Acinetobacter baumannii
GGFMADSSIPKDIADSLKSIFTNINTERISEILVGVVLCFIGFVLARIISNTFIRTVGSRFNAHQRLVWRRGIFYFIFLLFIMTSLKEAGFKLSVFLGAAGILTVALGFASQTSASNLISGLFLIGEGSFEVGDTIQITLIRGNTIEGEVISIDLLSVKLLTLDNVYIRLPNEQLIRAPVHNLSKYPIRRIPITLAINFHEDIIKVREVLLNVAANYPLVLDDPKPAVTVTAFRESSIELLFAMWCRQENSLKVRDEMQERIRNGFLDNQIEIPVPKMGLIDRPSTAFAEDDIDQYSNQKELKREPKA

SEQ ID NO: 8156 - protein, 255 aa, Acinetobacter baumannii
EVFMRRVLIAIASLVVITSIIFFTYQHIKQQQAKDSSQMFDVVMTEKMNQLYDQAQDWTKPVQLDIHDKRLAGHYKQVSEFLLSYWVQNVNARNEYLRELKAAKWDTFLNVDRLDHDKKQKYAETEKMLADVRRASDKYQSEYEKIHKTFLSKIQELSVDKEMRQILEIKLGAQQKADQDHAIFMIELQILDKAEEMFKLLKTYPWQKKDQMILFHENAQVKKFNTLYQDVLKLNAKIEKIKKKNVAALEGELKE

SEQ ID NO: 8157 - protein, 206 aa, Acinetobacter baumannii
MFIININKVGDIKVFKKALVIALMGVSSFTFAGNWQVKFGGSVIAPSEDTTTALGVVKADHEYAFTPSVEYFFGQTPFSAELLLATPINHDVLLDGQKVARIKQLPPTITAKYHFKNSTRFTPYIGIGATAFIPWDEQGVADKVKEDFGVAGQVGFNFQPADAKNWGVFVDVRYADISPEVTLTNGAKFDLDINPFVYTLGYSYKF

SEQ ID NO: 8158 - protein, 289 aa, Acinetobacter baumannii
SCIMNLAAFEAFVKVMETGSISVAADQLFITQPAVTKRIHSLEEYFGVKLFESAGRGVQATHAAHSLLPKVKSWLNELRDIHHTLSHEQTQIQGRLKIGTSHHIGLHHLPAPLKHFVQQFPQVTLDVHFVDSEQAHEQVLAGDLELAFLTLPPSGDERLNYITIWNDPLVFVAAPFHPLAQKKNLTLQDLIEYPSLLPAAQTYTAQITLAEFEKQCLKPKITMSNNPLESIRMLVSIGLGWSVLPKTLLNQDMQQLDLNVEMNRQLGMVWHPARTQSRAMQELIKMMQE

SEQ ID NO: 8159 - protein, 293 aa, Acinetobacter baumannii
EMIMQPKIYAVTTSDQQTLCAKAWGDEKNTPLVLVHGYPDNQEVWESVIEHLINDFYIVTYDVRGAGLSSIPKRIRDYRLERLSLDLQEVVDEVIPNRQFHMAAHDWGSIQSWESATEPKFKGRLLSYTTISGPCLDHAALFLREKFKTSPAQILKILTKSWYIGAFHLPLIAPTVWSLFSPEKWGKILNDLERKDNLPLNSNISSDGKYGINLYRANFIPRLTGPRQRYAQCPVKAIILKYDTFVSPEYITEAMPKWVENFEYVELEANHWAILSQAEKVAAHIRQFIDSQS

SEQ ID NO: 8160 - protein, 350 aa, Acinetobacter baumannii
AYVMIKLSTRGMMIMKAVAYQKAGPITLPEALVDIELDTPVAKGHDLLVRVQAVSVNPVDTKIRKNVSAEQSGWKVLGWDAVGTVEAIGDKVTQFKIGDVVWYAGALNRQGSNSELQLVDERIVGHKPKTLEATEAAALPLTAITAWEMLFDRLQVPKTAPANTTILVIGGAGGVGSITIQLLKQLTNLTIIATASRPETKEWVEQLGADYVLDHRQPLAAQIKQLGLSAPLYVFSTTETDQHLSDIVELIAPQGHFGLIDDPDQLDIKPFKSKSVSVHWEFMFTRSMFQTEDMEKQSALLNEVSKLVDEGKIKTTVTQVLSPINAENLTRVHEQIESGSTKGKIVLHGF

SEQ ID NO: 8161 - protein, 220 aa, Acinetobacter baumannii
TRIFMKLALFDLDHTLLNTDSDHSWGEFLVNEGLVDPVHHRQMNDKFYEDYKAGQLDPYAYNEFVFGFLTKHDNNYLTELHQLFMEKVIRPQMRPKGFDAIKKHQDLGHTIVGITATSDFITAPIFREFGITEILATNAEVADGKYTGKVAGLACYQKGKLARLEAWLDGRSVSESWAYSDSINDRFLLEYATHAIAVNPDDRLEKLAQENKWEIQDWSI

SEQ ID NO: 8162 - protein, 877 aa, Acinetobacter baumannii
LTSMTISHIDPEYQANTIEPSVQQDWENRKVFKVADTVEGKHRYILSMFPYPSGKLHMGHVRNYTIGDVISRFYRLKGETVLQPMGWDAFGLPAENAAIAHKVAPAKWTFENIAYMRDQLKKLGLSVDWDREFATCTPEYYHWEQWLFVQLYKKGLIYRKLSTVNWDPVDQTVLANEQVENGRGWRSGALVEKRDIPMYYFRITDYAQELLDDLDTLQDGWPQQVLTMQRNWIGRSTGMEITFPSANTEIYADGLTVYTTRADTLMGVTYVAVAAEHPLALKAAENNPELAAFIEECRMGSVAEADLATAEKKGMATGLFVKHPVTGEELPVWIANYVLMSYGSGAVMAVPAHDERDFEFANKFNLPIKQVIDAKGADDADYSATEWQEWYGSKEGKLVNSGEFDGLEFQAAFDAFLAKLEPQGLANSKVQFRLRDWGVSRQRYWGCPIPMINCDTCGQVTVPEDQLPVVLPTDVVPDGSGNPLNKMPEFYETKCPCCGGDARRETDTLDTFVESSWYYARYASPDFTGGMVKPEAAKNWLPVNQYIGGVEHAILHLLYARFFHKLMRDEGVVQGNEPFTNLLTQGMVLADTFYREAENGKKTWFNPADIELERDEKGRIISAKYSGDGQEVIIGGQEKMSKSKNNGIDPQAIIDQYGADTARVFMMFAAPPDQSLEWSDAGVEGANRFLKRVWRLVASFLEKGNSATAIDKANLSKDAQDLRRKTHETIQKVSDDIERRHAFNTAIAALMELLNASNKFEAKDDNDVAVEREAITTLLTLLAPFAPHLSQTLLAQFGTDLTEATFPEVDASALTRNTQTIVVQVNGKLRGKLEVSVDISKDELLAQAKALPEVQQFLTGPTKKEIVVPNKLVNLVV

SEQ ID NO: 8163 - protein, 316 aa, Acinetobacter baumannii
ILYIVMSQKQPYTPGEFQWSFLLPKYWGVWIAITFLMLLAILPWAIQWRLAHGLANLAWKYLKSRRKTTIRNLEVCFPEWSPEKVQQQAKQVFVDMMLGIFETLNAWYKPYWFKNRVTIEGLEHITNAQAQGKGVLLLGTHSTLLDAGGYVCAQYFEPDVVYRPQNNPLLDMLIYRCRGTIYKAQIDHDDMRGLIRHLKEGDAIWYSPDQDFGLKQGVMAPFFGVPAATVTAHRRLLKISKAVAVPLYFYRHGDVQDPKYHILIELAVDNMPSEDEVDDATRVNKIIENQLRIAPTQYMWFHRRFKTRPEGYEEIY

SEQ ID NO: 8164 - protein, 892 aa, Acinetobacter baumannii
SLIFKFIGIGITFYMANTSRSASQSTASSASAAHKRALVIVESPAKAKTINKYLGSQYIVKSSVGHVRDLPTGGSKATEKKPAARTKLTEAEKEQKANQALINRMGVDPEHGWQAHYEVLPGKENVVAELKKLAKDADAIYLATDLDREGEAIAWHLREVIGGDDSRYHRVVFNEITKNAIQEAFKQPTRLDLNRVNAQQARRFLDRVVGFMVSPLLWEKIARGLSAGRVQSVAVKLVVEREREIRAFIPEEYWQVFADTKAKKDDIRLEAVKQAGKTLKLKNKAETDALLDVLKGAEYKVAQREDKPTKVNPSAPYITSTLQQAASTRLGFSVKKTMMLAQRLYEAGFITYMRTDSTFLSDDAVSMVRAHIESQYGEKYLPAKPNRYGNKAGAQEAHEAIRPSNVALTGDQLAGVERDAQRLYDLIWRQFVACQMTPAEYLSSTLTVEAGNVELKAKGRTLVFDGFTKVRGANKSDDDIILPAIKVGEILKLEKLDPSQHFTKPPARFTEASLVKELEKRGIGRPSTYAAIISTIQERGYVKLENRRLFAEKMGEIVTDRLDESFNNLMNYAFTADLEGQLDRVATGERNWKELLDTFYGDFKKRLTNAQGEQGMRRNQPVEVPAVHCPECSRPMQIRTGTTGVFLGCSGYNLPPKERCKGTLNLTPVESLAALSDDDSAETADLMSKHRCPKCGTAMDSYVIDGGRKLHVCGNNPDCDGYELEEGEFKIKGYDGPTIPCDKCDGEMQLKTGRFGPYFACTSCDNTRKVLKNGQPAPPRVEPIKMEHLRSTKHDDYFVLRDGAAGLFLAASKFPKIRETRAPKVAELRSVADQLDPKYQFILQAPDVDPEGNPTIVKFSRKNQSQYVGSETPEGKQTKWSLIYQDGKWIEG

SEQ ID NO: 8165 - protein, 940 aa, Acinetobacter baumannii
RCHIAKPMYKKDKQGMIIVLIALTLFLAISIGFKFQSAVIALSIALTVILVQSLSSLHQRLTHLEQQFSHQTTPLYSIHMQRTVIYTAALVALIAYINHWMWIAGGALLVLLLCLIQTISAFHTRLLFLETAKQTVNESIHTEVITPVLEQVVPNNITEPALPETTALNQEEQIVRTQTTAWWQPAVDWMIHGNPILRVAVAVLMVGVVLLLRFASEHWQLSLGVKLGFIAIAGGVLTAFGYTLQKKNQLFAVALQGVGLAVVFLTLVFSHHFGVITSLTTASILFTILLAITVFLSLKQQAIYLAILALGMAYAAPLVIPQYRPDVVFLFSYYLVINLAVAAVNFIQPWKILNQIAFFATMFIGGSAIAFYAEPAKFDTLDWILWLHIALFIWLSVRYSQNISRVSEHEKQEGIRLPPLLDVGLIFNVPVLGFTLHAYLVHESTQALTIGAAVLAGTYAVLTFWIKKTHPQLSVLAKSFFILAVAFFALIFPLAKGAHWTAIGWVAQGTALIVWGVTERYRLSRYIGVILVLLSSLALFYQVWANEEFPTLSTSIYAIAQFISAFYLLQYNSKEQRYFSASMFSGIFLCLGMYAGAVAGVEIMAWHHHALSPYLMFAIALIAIFSAIVHYKLRVQWQSLQLILISLLLLLVLGEAFASQVFTLFKWVDSLQQTTFLVSTIILSGLFIMAQPQSSHLGYVKVWAGLSWLALAIVGVAIFPKMPIVALAFVPVVYSLWAYKAHKTTLLHQIPVWCLSLIWLLVVSVDRHSAEYLYFVPLFNLTDFFSILVFAGLLFIIYQHAFDQDKSLEWTFKITTILVGLLVFSSVVVRGLHHYWATPLWSASIWTNGVVQLSLTLLWVILAFILTTYSSRKMIRQLWFVGAALLGIVVLKLILLDLSQSATLTRVISFIGAGGVMLIIAYLAPLPPSSSVQKNQEPKL

SEQ ID NO: 8166 - protein, 121 aa, Acinetobacter baumannii
RNNMMNRKFAMGLALFSGLAFTHSLQAASFSCSAAKTKTELSICKNRSLNDADVKMATTYQIVLHALPMGGRDNQKDTQQQWLKKRNACAANVSCISKAYQQRQKQLDTILQDRVLSHGPF

SEQ ID NO: 8167 - protein, 279 aa, Acinetobacter baumannii
RDNIRPMKKATQSKAWTTVQIARHPERPQFLDYVGEIFTEFDALHGDRLFGDDGAMVGGLARFDGQPVMVIGQHRGRSTREKLKHNFGMCNPEGYRKSQRLLDMAERFNLPVFTFIDTMGAYPGVGAEERGQAEAIATSLAQLSSLKVPVIATVLGEGGSGGALGIGVADRVIMLSHSIYSVISPEGCASILWKTAEKAAQASEALGLTADKLQSLGIVEYVVDEGEGAHLDPERVMQNLKVVLKQALDELLPMDANERCEARYQRLMKFGSENLGMAS

SEQ ID NO: 8168 - protein, 609 aa, Acinetobacter baumannii
VFNIKPCMPIVNQNARPHIEKILANLTQLPGVYKMLGKEGELLYVGKAKNLKNRVSSYFVKTIEHPKTQALVARIYDIETLVTRSETEALLLEQNLIKQHRPPYNIMLRDDKSYVYIFVSADKPYPRIASGRGKGKHQIGKFFGPYPSAYSARDTLLVLQKLFNVRQCENSYFSQRKRPCLQYQIKRCSAPCVGLVSPEDYKEDVNNSIRFLQGDTKELNQELIAKMEQAAADLEFEKAVFYRDRLSLLREVQAQQAVFKVKGEADILAIAYQAGVTCVQIMHVRNGRMLGGKSYFPDMLGDDLGQMLSDFMANFYFQVADEVPSELIVNTALPDRKELEEALAQQFGKKVQIKSSVRETRAEWLELAEMNVQHAIKGQLSNHLELNERFHQLEQVVGRPIDRIECFDISHTMGEAPIASCVVFDQGGARKRDYRQFAIQDITAGDDYAAMRQALTRRYKKAMLPDLLLIDGGKGQLHMAMEVMQELGLEAFMVGVSKGEGRKPGLETLHFTDGTKIQLPEDSKALHLIQQVRDEAHRFAITKHRAKRDKRRSTSVLEAIPGLGPKRRRDLLTHFGGIQGVLKASEKELTVVPGLGEVMARTIYKILHE

SEQ ID NO: 8169 - protein, 317 aa, Acinetobacter baumannii
RQNMMLTSKASLRLTLLASAIFLVACQPKSDPKESEDQQKPAVVEQKPVELTLKGETVPSKVTLPDCDGKTCPEFTVERLQSNFPFIDKIIDQQVLKALGQILEIAEPDAKAAQADKKTEASAAAATEQQDSFDAQVQRYANSFIDLDNELKALSSNHQINLLVKPKIIQSQGKVVTVVVNSSSYLGGAHGSAAQQYYNFDLKKEKQVKLEDLLRPEKKAALDKLAHEAFKAWVTDSKLANSVSEYEQAWPFKLTENFLLGDQGLILQYGEYEIGPYVVGLPRLVIPYDQLQDVLKEEYLPQPKAKPASTPAVKSTS

SEQ ID NO: 8170 - protein, 281 aa, Acinetobacter baumannii
MANIVMATAVNCNICFIGGGNMAQALIGGLISRGLPPTRITVSDPVEQIRQLLQEKEVHVTQDNTAAIQNADVVVLAVKPQVLANVLRPLKGLLSDKLVISIIAGAEIKTISNLIDSERIVRVMPNTPALVQTGAHGIYATDVVGASDRELTSQILAATGLTIWVNSEAQIDAVTAVSGSGPAYFFYLMESMIRAGKNLGLDEKVATALTLQTALGAAQMAITSSNTPSELRKNVTSPNGTTQAALEVFDRAQISQNIQSALAAAQKRSQELAQELSDSAK

SEQ ID NO: 8171 - protein, 253 aa, Acinetobacter baumannii
FCDIEKSKENALRDVMRYLIIAISCAALLAGCQSSSHLEKNSGELTATLPKVDVDKEPGLLDQYRLGGFTVGGWVNQKLGQTFAPVKPQNEQAAVVYLYRPDTKWNRQEIAAINLFVNGKRIPSLLHNHYYWIELPAGTYRISASRPLLGIHFQEPKYIDITVDAGASYYLKYDEENKMDRSEHTGPFMLMQDNIGRREIAFTELKSSSYNFVAEDASGKIRHKPQELKPAKYNEKSDVHLIKPFKLWNPLTW

SEQ ID NO: 8172 - protein, 472 aa, Acinetobacter baumannii
GYCMKPVIALIGRPNVGKSTLFNQITKSRDALVADFAGLTRDRKYGDATYQNKSFIVVDTGGIGESEGGIDNYMAEQSKTAINEADIIIFVVDARAGLLASDEQIARELRTLGKKIYLVANKVDGVHAEAALVEFYKLGMGEPLQVAASHGRGVQQMLEDVLQDIPEDESPEEHDKDTGLRLAIIGRPNVGKSTLVNRLLGEDRVVAFDQPGTTRDSIYIPFEREGRKYTLIDTAGVRRKGKVDEMIEKFSIVKTLQAMKDAHVVVVVVDAREGIVEQDLHLIGYALEAGRAMVIAINKWDNMSEYDRKQCKLDVERRFDFIPWARIHLISALHGTGVGELYPSIHRAYESANLKVSPAKLTQILNDATDQHQPPTVQGRRIKMRYAHMGGQNPPTIVIHGNKVDKTPADYRRYLENVFRKVYKLEGTPVKIEFKTSENPFEGRKSQVDERTAARRRRYIQKFKKAEKKFKR

SEQ ID NO: 8173 - protein, 244 aa, Acinetobacter baumannii
EKSILNRCKSMNLPNVDMNLLDRPTLEKVQAKALDHAPRILLLYGSNRERSYSRLAVMEAGRILEEFGAEVKIFHPKGLPLPEDADTEHPKVKELHELLAWSEGMVWCSPERHGSMSSIFKSQIDWIPLAGGAIRATQGKTLALMQVSGGSQSFNSVNQMRILGRWMRMITIPNQSSIPKAFLEFEEDGRMKASSYYDRIVDVMEELYKFTLLTRGQSLYLTDRYSERKESAEELSKRVNQRSL

SEQ ID NO: 8174 - protein, 533 aa, Acinetobacter baumannii
VYFMSFKDELAAQVAQRRTFAIISHPDAGKTTMTEKLLLWGKAIQVAGMVKSRKSDRAATSDWMEMEKERGISITTSVMQFPYKGHTINLLDTPGHEDFSEDTYRTLTAVDSALMVIDGAKGVEERTIKLMEVCRMRDTPIISFVNKMDREIREPLELLDEIENVLNIRCVPITWPLGMGRDFAGVYNILEDKLYVYKAGFGSTITDIEVRDGYNHADIREKVGELAWASFEESLELVQMANEPLDRELFLQGKQTPVLFGTALGNFGVDHVLDAFMNWAPEPKAHPTQERMVEAKEEGFSGFVFKIQANMDPKHRDRIAFMRICSGKYEKGLKMNHVRIGKEVRISDALTFLAGEREHLEEAWPGDIIGLHNHGTIQIGDTFTSGENLHFTGIPHFAPEMFRRVRLKDPLKSKQLQKGLKELSEEGATQVFMPQISNDLIVGAVGVLQFDVVAYRLKEEYKVDCVYEPVSVNTVRWIHCDDEKILNEFKKKAHDQLSIDGGGHLTYLAPSRVNLQIMQERWPDIEFRSTREH

SEQ ID NO: 8175 - protein, 227 aa, Acinetobacter baumannii
MRILLVEDEQKTGDYLKQGLSEAGYITDWVTDGLSGKHQALSEEYDLIILDVMLPKLDGWNIINDIRKSGKTMPILFLSARDQIEDRVKGLELGADDYLVKPFAFAELLARIKTLLRRGQQKEDSNIITIADLELDLRKRRVTRAGQRIDLTAKEFALMELFMRRRGEILPRALIASQIWDMNFDSDTNVVEVAIKRLRNKIDSNFSPKLIQNIRGMGYVLEVEDDS

SEQ ID NO: 8176 - protein, 702 aa, Acinetobacter baumannii
DEFMLLKQILAFRPSKLDLIFAIKTFIAGMLALFVSFELDLINPMWSIGTVLIIANPYSGMVSSKCFYRLLGTVGGAIIALTITPHLINTPWIFTVVLSLWVGFALYVSLLDRTPRSYAFMLAGYSTAMIVYNAITYIDQYNIFDIALARVLEISIGVISSAVVSATILPMHIGSAIKQRVTKTLKDTENLFANLLNADQQQNNTQLLAAITRDTTDIHALAVHLSYEKGELHGMTKPLQEMLHQMSMVVANLVALSERIKQLQELNFIESHSDKLKQLSGHVIHFLEQKDQMTDENILQLPDEFENDFLNLNDSASEHQQVLLAAMKMDVRHFISNVLAVKVLWQRIKQGNKEIPDNITPMTTKYPSLHRDHGVAVRGGISAVLITFIVTGVWILSGWKAGFMMAQIGAVTACILTALDNPVPVLRIFIWGSVASAVLVFIYAFGIFPHVTTFWELGLVLLPMFLFAVSMMANQALMPVGMVLGINTMMGLNLHNAYSMDAVSYLDSSFGMVMGVLVSLVVIDVVRAMSPDTSANRILALHYRAMRQAIYIPYGIEFKVHLRGMLDRVGVLNTKMVQSEEIKKSIQQALVESSAIIDLSRLQELANQVPISSELAHHIGRLQQDLDELFRAKENEKGESDVLVQHIHQTLFELKQLASNIEDMTLRQRLFISLNNIAYSMCHVSSNQMNADRTLTGATAHG

SEQ ID NO: 8177 - protein, 306 aa, Acinetobacter baumannii
FLIFRKMNQFSSFSFEYRSTALLCIYSLGMLVLIPHIQLFPTSLKHSRSTRRTLYSSVVTLKTKSQSVSFLHSPCEVEPSHSSDTALIQDLMAVFGNDTLWSRAAQHKHPYKTFGKIKKKASTPHVSENNPLTASWNTISTWMPFENDLDLGSNSESDVYVQFLAKKKWNLRHNISLDTEQIFRYGSTSRNYTETTLNLTQKMQDNTLFSNTFNVNKSGKEDYNWGNWTFQQFEFIKDNRLTYGIYSGGVYANNDIRLNSWGPYISWRQPIWRDWIFMQNDLNFFNHLDDDPKHQLSVQMNLEANF

SEQ ID NO: 8178 - protein, 378 aa, Acinetobacter baumannii
GTLMQIGIPTETVVGENRVAATPETVKKLISAGHSVVIERGAGVKAAYIDSAYEQVGATITDDAYTGSQIILKVRAPQGGEIQKLAANTTVVAMFDPYRNTELDQFANQQVSAFALELLPRTLSRAQNMDVLSSQANLAGYKSVLLAAAEYQRMFPMLMTAAGTVKPARVVIMGVGVAGLQAIATAKRLGAIVEATDLRPTAKDQVESLGGKWLDVPMSEEEQQRAADAAKNGYGWMPGEQYIKDQAAIVDKAVSNADIVITTALLPGRDAPRLIKAETVAKMKPGSVILDMAVETGGNVEGSKVGETVVTENGVKILGIPNIPATVATEASALYARNVFNFVETLFDKEKNFAINQEDEIQKALLVTHGGQVLLKRG

SEQ ID NO: 8179 - protein, 307 aa, Acinetobacter baumannii
VLIMSNTQPDFLADEFLLDHYVGKTPLVRLQRLACHTQATVLAKLEGNNPAGSVKDRPAYNMIMQAEKRGQIKPGDTLVEATSGNTGIALAMVAAMRGYKMKLIMPGNSSQERKDAMRAYGAELIEAPNMEAARDMALQMQAEGLGLVLNQFGNPDNVEAHYLTTGPEIWKQTGGKITHFVSSMGTTGTIMGVSKYLKEQNPDIQIIGLQPSEGSNIAGIRRWPQEYLPTIFEPKRVDQIMDIPQIEAEKTARRLAREEGISAGTSSGGAVWASVKIAEENPDAVIVCIICDRGDRYLSTGLFSVQD

SEQ ID NO: 8180 - protein, 780 aa, Acinetobacter baumannii
EFPMTELTPYHEDQKLDNNTSDNIHFRDILEQHISRRSLITKAASGAVALTLASTLTGCNDNDDDSGSNNGGTTPVDPNKKPEKLTFTPVAKNLNDIVTVPEGYEANVIYALGDSINPRVGDWDDNNIPSGPSFQFRSGDCHDGMHYFGLNTSTNRFDETVSAQGLLVMNHEYINQTFLHPKGPTKVDGRRPEDEVIRETNAHGVSVVHIKKDPTTQKVEIVKNSIFNRRITASTVMEFAGAAAGSSLLATRFSPAGRQTRGTHNNCGNGYTPWGTYLTTEENFIGYFQRSGSDEYARTDAEKIALKRYGLGVKKDEPYLYEKDEKGAPKKDKDGKIIYLKDKNGELIPNVDEQGRQIYLGTSSRYGWETAIGQVESQDLYDRWNADVKAAQATQDYRNGPNTFGWMVEIDPFDGRQNPVKRTSLGRFAHEDSACRAVVGQPLAFYMGDDSRGEYIYKFVSTAVWDTKDINGGYTAGDKYMNAGKLYVAKFNNDGSGQWIELAYGKNGLNESNTTYPFKSQADVVTFARLAADSVGATKMDRPEWCTVNPVNGEIYVTLTNNSNRGKDYATDAANPRNYTDLYAGTKEQKGNVNGHIIRFKETDDKTTAETFKWDIYLFGAEAAMASNINLSGLTDNNDFSSPDGMWFDPRGVLWIETDDGAYTDVTNCMMLAALPGQIGDGGTATTSNGQQTITGAKVTDATLRRFLVGPKQCEITGIAMTPDYKAIFINVQHPGEDSPSYAKPESNWPATQKDPSNKTARPRSATVVITRKDGGVIAG

SEQ ID NO: 8181 - protein, 237 aa, Acinetobacter baumannii
DSPMRVDVWSDVVCPFCYIGKKRLEHVAAEAGIELDIHWHSFELDPDAPAKHDTSNTERLAKKYGRTYEEMEEMERNIAAMAASEGIDFQWQKANSGNSFNAHRIIHLAQSKGLGNEAKEAFFHAYMTEGLAIGEREVVEEIASRIGLDNAEVEYVLDTNELADFVRHDEKIAHEQLNVTGVPFFVFDQRIALAGAQPREVFLQVLEQAQLKANAENIEQDDAAVCNDETCDIPQNK

SEQ ID NO: 8182 - protein, 404 aa, Acinetobacter baumannii
NITMPAYQFTAIDASGKQQKGVLEGDSARQIRQQLRDKAWTPISVDPVEQKDKHQSHGLFQKKFSAYDLALMTRQLSVLVAAAIPLEEALRAVSRQSEKAHVQNLLLSVRSKVLEGHSLAQGMQQSGRFPDLYIATVAAGERSGHLDLILDQLSDYTENRFAMQKKVQGAMIYPIILMLMSFGIVMGLMTYVVPEIVKTFDQSKDALPWITVALMKASDFIRHAWVFIILFAIVGVVAFVRFLKTTAGHYAFDRLTLKLPLFGKLSRGINAARFASTLSILTRSGVPLVDALKIGAAVTNNWVIRDSISQAAERVTEGGNLGTQLERSGYFPPMMVQMIRSGEASGELDRMLERASTMQDREVTTFISTLLALLEPLMLVLMASIVLVIVIAVMLPIVNMNNMI

SEQ ID NO: 8183 - protein, 500 aa, Acinetobacter baumannii
GAAIMLRNKLALTVMGVAVISLAAGGGAGYWIAHQKYNPQSGPQQAAKVLYWYDPMKPEQHFDKPGKSPFMDMQLVPKYADENTMMTEDSYPAVKIDPSLQQNLAIRYASVEQAVMGNALLTNGILQTNERQVAILQTRASGFVQRVYGHAVGDMVTQGSPIADISIPEWTGEQTEFLAVLRTGDRSLIQASRQRLQLLGIPQNVINQVERTHRVQSNMTLSAPVSGFIDSLEVRNGMALAMGQTLVTIKGISPIWLEASVPEAQIAGIKRGMKVEATFVAYPQIVSGKVIDILPTLDSTSRTIKVRIELPNREGMLKPGMFASVKFSNNPQSNLVIPEQAVIRTGTRNVVIVGHEQGRFEPVVVQLGQSDGNKIAILQGLKAGQKVVISGQFLIDSEANLQGVLDKLNTGQSMTSSQVVKTSIYQGIGKVEKVTAQDITISHQAIPELGWGAMTMSFKQPVQPFTQIQQGDQVRFRFTHARDTYVISDISKMSMTSMKN

SEQ ID NO: 8184 - protein, 344 aa, Acinetobacter baumannii
SIYMEGHCVGQLTDASVVLRFGYQAIRRAGLPTEEILTKAGVALNQVDTNARTPLSAQYAFWTAAQEVSKDPDIGLHLGEHLPLYRGQVIEHLFISSETFGEGLKRALAYQRLISDAFDAKLVVEDGRCYLTNGEQVGADNLVNRHFSECAISGVLRFFKFITEGQFHPIFIDFNFSEGASEDEYFRVYGCPVSLGQKETRLYFDPAILDFQLWQAEPELLQLHEQLAIEKLQELARYDLVGEVRRAIGSTLESGETTLETVAAQLNITPRRLRTQLSEANTSFQQILSDYRCRLAKKLLANTNESVERIVYLTGFSEPSTFYRAFKRWTNETPVEYRKRKQHR

SEQ ID NO: 8185 - protein, 386 aa, Acinetobacter baumannii
QQNIKIDMKTFHIITYRQLFALLTLGFGSVCMAHAEVNSSSTQQVNGLSSGAQAEENKDENLLDQIPRWIDATPTIFPEQSNEPIVPPTEQTEDQTWFDRKQKKIRNWADRTSGKIDNWFGEVDPQKPASATIRVMIDNYWNEYDNYEIKPRIRGKIKLPTLEKRLSVVFGDDSLDDEFNNSPANINQNPNQDPNKKLDGKRTRDDNSSIALRWSNFSKKLPFETDADLGIRSGDDIYVRLKASRDWQLRNDFKFYAEQIYRYGIDSENYLRTNLELTHARPNQPILSNQFSLTYADDQDDDLTWENRLFREHSFFANNRFNYGIYTGGYYNDNDLRLNSWGPFVSWRQPVLREWFFVQGDLNYFNDHREDRNHYVSTFLRLEALF

SEQ ID NO: 8186 - protein, 88 aa, Acinetobacter baumannii
LVCIYTKIYTIMEKMVHGVNLWGQLLPEKVQMEVLVTELLSGSTKKVIQLILKAKHFIQKKWQKTGLKKEEVEIQENPDILLGKETTD

SEQ ID NO: 8187 - protein, 252 aa, Acinetobacter baumannii
RSCMAKPEYYYGVHSVESLLELEPERVLTLFTLKGRDDQRLQKILQLAEPFGISVQKASRDSLEKLAGLPFHQGVVAAVRPHPTLNEKDLDQLLAETPDALLLALDQVTDPHNLGACIRTAAAMGVQAVIVPRDRSASLTPTARKVAAGGAEKVKFIQVTNLARTLAHLKETTHVRVIGTMLDENALPIQKCDFSGAVVIVMGAEDIGLRPITQAQCDQKAYIPMSGNLQSLNVSVATGMALYEACRQRSEV

SEQ ID NO: 8188 - protein, 61 aa, Acinetobacter baumannii
CRCITTCFTKYDSTRIDMDAAQSELSSVVGIQKKAFFYIYFSYLGRFIILANSGHIKIMGR

SEQ ID NO: 8189 - protein, 232 aa, Acinetobacter baumannii
TWRICVWCTCWRRATRADLRQRNYKVMSKIEDVVKLGPVIPVLAFDSAEQGEHVSRALHAGGVKVLEITLRTAAGLAAIERASQLADDIVVGVGTITKPEHCAQAKKAGAKFGVSPGLTKDLHLAAQDAGLPLLPGVMTPSDLIQAIELGYDIVKFFPAQQAGGVEMLKAFYGPFPNLRFCPTGGITAETAPDFLKQPNVVCVGGSWLTPKPVVAAQDWAEITRLAQIASQL

SEQ ID NO: 8190 - protein, 441 aa, Acinetobacter baumannii
SLSMKINILMDGAMQGSYATALLKQQQLPESFQFYFKQKQHLSNTQELHQLHELVRPRLKIAIVTETWPPEINGVALSLLQLCQGLQKQGHKILLVRPEQKAKCHDFLPEQECLVMSQAIPKYPTLQFGWPQYLKVSKAFEKFVPDVVHIVTEGPLGLTAMQAAKAKDIPVSSGFHSPFQDFSRFFDLAFLVKPIQKYLCWFHNNTQVTCVPSKDTEEALRGFGITCPLVVVGRGVDTTRFSPKHRSESLRQQWGVDSDTRVMLYVGRLSPEKEVQLIVESYAAMQNIQQQKTKLVVVGDGPDLARLKALPEAKNVIFTGSLRGHDLAVAYASADVFVFASQVETFGNVVLEAMASGLPVIAYDYACAHQYLIHGVNGWLSPLGHKNHFIQQIYQLPSIQQLREMGIQACHKVQQSGWQLPVQQLEQAFYQVVKEPSADFT

SEQ ID NO: 8191 - protein, 99 aa, Acinetobacter baumannii
VFLISNLFCESDAMLFKKFAVAAAVAATLAFVGCSKKEEAPAANAASEATAAASEATAAASEAATAASQAVDAAASEAAASTAAASAPAASEAAASAAH

SEQ ID NO: 8192 - protein, 135 aa, Acinetobacter baumannii
HVLILKGDEMKIFQNKVSVLRNVLVGATMAIAASSAFAHVKLESATPAINASVAGQPKNITLNFGGEVMLMNVKLLDAQRKDIPLNYQVTHDLKKSFEVAIPKLKKGKYTVVWTTMGTDGHNMNGEYSFTIKSAK

SEQ ID NO: 8193 - protein, 182 aa, Acinetobacter baumannii
GRLIVARRPKRYTEEDFDSLEGRASKTEQKKAVQRMAALGEQLAQLSIKQIQKLPVDERLIDALLEVQNISSFEARRRQFQRVGKLLRNEDETVILSYLTPQQGAKKQAQLMRWVDRMIEQGDPAINEFSKIYNASERHTLRQHVLRINRDKTQQVAEADLEATKMKFINYVQQVALLSDQG

SEQ ID NO: 8194 - protein, 156 aa, Acinetobacter baumannii
KRLIGFAMDNIGIWVTVIIVLFVLGSIFGLRVSPREKALGIMRDKARKMGLHPRVIAAPEWTHVPMATEKRASMVAYYSVLIPDARLPLMRARVIDGKLKVVQGDEKFNDSPIALKGIYAIDMQANCVGLYWDEESDLKATQLDEMKAYLLALAEA

SEQ ID NO: 8195 - protein, 133 aa, Acinetobacter baumannii
VFLMFMKIGELSEKTSCSVLTIRFYEKEGLIPQPDRTQGNYRLYTEDYIDRLKFIVNCRSLNMNLTEIKKLLNYKDLPNLNCSDVNELIDSHINDVKENIRNQQKLIQQLLEIRKTCDGLCTVDKCGVLKKLA

SEQ ID NO: 8196 - protein, 352 aa, Acinetobacter baumannii
MALIRKRRLTEQQQRRIEKQHKTRQEEVDTSQDLDGLVVQHYGRQLEVQALSVPDHHPEKPQVAEGEPEPFWKPIELNSVWRCHTRTNLELLVTGDRVKWQADPNTGLGIITAIHPRTSLLTRPDRYHKVKPVAANISLIVIVFAPLPEPAPTLIDRYLVACADANIPALLVLNKSDLLTENDPILDMLKEYENLGYEVMICHSKGDISVLSQRLDGETVAFVGQSGVGKSSLINVLIPDAEQKTNIISENSALGQHTTTSTRLINFGKNGALIDSPGIREFGLWHLDLDKIRMGFPEIEAHLGSCQFRNCTHTHEKNCGLKQAVEAGEILPRRLDSFLRLIDEIQEAQQKN

SEQ ID NO: 8197 - protein, 351 aa, Acinetobacter baumannii
SWLIQAISRLWGDKGIAMLDTRYQIFISTSGREMQPERMVLSQTLVNMGFFAWGLEYRNPLTTTLARRQIDESDYVVLLLGSQYGEQSISGASYFSLEYEYALSRAKPIVVFMHEQPESRDIHLQEAHPQLKEKFLAFRKKLLHEANHIFYFKSPRDLELAVRLNMPLMVEQYMGQGWVPARQAHHLEDEINRLKSKILQLEQQLSESSIQANEVAPQDVFAFEYQIQAFQDGNFKELKRQRQMTWSQLLSILAKHFETAMPEENFGTCLNEYLNQDGLEDARQELPRAHAVAGAQINHKALFRIKKQMQSQGWIVPTKIDQQHSLWKVTTKAQKLLLSYKWNHRSTRLKA

SEQ ID NO: 8198 - protein, 198 aa, Acinetobacter baumannii
YLIIRVAVMKTVGNDLVRNQLHADRKWYLILGFVLIIFGLVLFSSLPFATFSVVFLFGILMMVGGVLHLIAALSVFKGGSRWLWALFGVLYLMAGYYAFSTPVTTAVVLTSLLSIALIIAGVIRTINAFLLRPIAGWGWTLFSGLLTLATGILILVSKDSPFWVLGMFLAVDILFQGINFLGLASAIKHLPSSSKTVS

SEQ ID NO: 8199 - protein, 353 aa, Acinetobacter baumannii
RKSIMAHQIETMAFVGQTPWHGLGNQLPQNQPIEVWAQQAGMDWRIESSNVSFMAKNERGQNILMPYEEQRVLYRSDTHAPLSVVSQRYQEVQPKEILEFYRDLTEQSGFELETAGVLKGGRKFWALARTGQSAALKGKDVSNGYILLATACDGTLATTAQFTSVRVVCNNTLAIALRGQNSSAGVVKVPHSTKFDAEKIKQQLGISVHAWGEHMYEMKQLSQRKVTQQEAAAYFDAVFNNTNLSIAEQDESIIQFYRNVATPKQINSSKADNKTEPNGRAMSKVMAMFNGHGRGAELASAKDTAYGLLCSITEFVDHERRAISTDHRLDSAWFGVGANLKQRGLEQALRMVV

SEQ ID NO: 8200 - protein, 92 aa, Acinetobacter baumannii
KYQIQVERMVMANIQKFVVNNQRTLKKTLSYYIMHITVAMLVAYFVTGNIWMALTLSMLEPTVQAFAFFFHEKVWAAKDRRISALSENETTA

SEQ ID NO: 8201 - protein, 285 aa, Acinetobacter baumannii
QMQMLSSRQFAAIATIIEYLYEHLDQQPSLEDVATYMNLSASYIQRQFQEWVGISPKKFVQYMSLQQAKYYLMQQRSLLDTALNTGLSGTGRLHDLFIQLEGMTPGEYKQQGDGVELNYSVETSPFGDLLVVSSDKGICSVRFVDSRENIEDIIKQYFPKAQLRNHSPIWHQQIAQWFRQDFSEHLQQKLPLNLAGTPFQLQVWEALLTIPEGQLRTYQDIAEQIGKPKAVRAVATAIGQNPIAYLIPCHRVIRATGMVGEYHWQKGRKLALLAWEMAKQQGEIA

SEQ ID NO: 8202 - protein, 336 aa, Acinetobacter baumannii
VSKMNQLELKKVIRPVILIVALMIAVYTIVHLWNYYNAAPWTRDGRVRGDVIQVSSDVAGLVTEVLVQDNQTVKKGQVLFKIDVSRRALDVEQAKSDLAKAKAAYAQAQAGLAQAKANLIKSSTNIKLAEKNANRYSNLMDGAISKQEQDQVFATRDQSHAEHEQLQAAIQQAEATIKQQQALVEAATSNLHLAELNMHRAAVVAPADGTLSNFDLRPGNYVQVGQAVAALLDRKQLYVVGYFEETKLDRIHIGDEATVQLMGDRQKIKGHVQGIASGIEDRERSSSSKLLANVNPTFSWVRLAQRVPVKIVLDEAPKNELAFVSGRTATVHIIEK

SEQ ID NO: 8203 - protein, 773 aa, Acinetobacter baumannii
SKKILEYTSMSNMQLDTLRRIVQEINASVSLHESLDIMVNQVAEAMKVDVCSIYLLDERNQRYVLMASKGLNPESVGHVSLQLGEGLVGLVGQREEIVNLDNAPKHERFLYLPETGEEIYNSFLGVPVMYRRKVMGVLVVQNRLPQDFSEAAESFLVTLCAQLSGVIAHAHAVGNIDVFRKPSNGPAYKTFQGVSGAGGVALGRAIILYPPADLGSVPDREAEDISDELRILDQAISSVRSEIRSLDEKMHDSLMAEERALFSVFLRMLDENALPAEIKELIRDGHWAQGAVRRVIEKHTALFAQMEDDYLRERVSDLKDLGRRILAYLQEEDSSHRELSPDSILIGEEISTAALVELPVDNIAAIVTSEGAANSHMVIVARALGIPTVVGVTELPVNTLDDAEMIVDAYQGRVFVNPPRRLRQRYKEIQKEDEQIAKDLKQYETKEAITPDGVSVQLFVNTGLMIDVVRGVQRGAQGVGLYRSEIPFMLRERFPGEEEQRAIYRQQLSHFANKPVVMRTLDIGADKDLPYFSIEEENSALGWRGIRFTLDHPEIFSAQIRAMLKASIGLNNLHILLPMVTTVSEVEEVLYLLERDWIAVQEEEQVKITKPKIGIMVEVPSVLLQIDEFAELVDFFSVGSNDLTQYLLAVDRNNPHVANVYSHFHPSILRALTRLVKECHKYQKPVSICGEMAGDPLSAILLMAMGFNTLSMSSSNILRVRKAICHVPMSDAQKLLDDVMKMNNPLIVKSWLEYYFKTHGLADMVKSNRLVSV

SEQ ID NO: 8204 - protein, 69 aa, Acinetobacter baumannii
VKKIILVITTRLAIAIKTRRINTSYFHSYSFALYSYKIELIALYMPFISQYATLYSPFNALNPCTSSLL

SEQ ID NO: 8205 - protein, 225 aa, Acinetobacter baumannii
LNPLNEFESQRLTLIRSSNMNFSIYWQHADAVSKTLYFILLAMSIATWTVFILRLMGTRQLKQQAYAQLSQAITSLKAKLQPLSFEQRKAVAEQALLRQISAEKANADKGISVLGTIASIAPFVGLFGTVWGIFHALVAVGKSGQAGLAQVATPVGEALIMTGLGLAVAIPAVLAYNICVRANRGLAHDLQDQAHSLLIDTMLQQDSTVKSDVKTAQQSYVGGQA

SEQ ID NO: 8206 - protein, 201 aa, Acinetobacter baumannii
LSEICRRRTWPVYCGVRKIKQPDRNQQQGAKSNRPAINDEIRAKEVRLVGADGEQKGIVSLNEALRAAEDADLDLVEIVANAEPPVCKIMDYNKHLFDLKQKQKDAKKKQHQVQVKEIKLRPATDVGDYQVKLRAILKFLEEGNKVKITLRFRGREMAHQQLGLAQLQKIEADVAELGVVEQAPKMEGRQMGMLLGPKKKK

SEQ ID NO: 8207 - protein, 209 aa, Acinetobacter baumannii
ENRMIDLYYWGTPNGHKITIALEEMGLDYTLYPINILENDQFQPGFLKISPNNKIPAIVDQDGPRGEPISVFESGAILQYLGRKTGLFYPTDEQERVEVEQWLMWQMGGLGPMLGQNHHFNRFAPEKIPYAIDRYVNETKRLYGVLNKQLIGQKFVAGEYSIADMAILPWILRYEWQGIQLEDYPYVQEYIVRLTARPAVQKALSIKVI

SEQ ID NO: 8208 - protein, 162 aa, Acinetobacter baumannii
SCFFTLQVSKSNLLFFNDKYNSIYREKMNISTLCQMSLLSFMLFNINGCASHPRQSVDLQEYLKNFIGKSSTTIQQDLNLRSLGFQVARTPQKTSDQLIYTILRPLSIPIPMVSNVDMRGGSVPIQSGNLSGNSYDINFNCKVIFKLKNDIAESIQYEGKAC

SEQ ID NO: 8209 - protein, 214 aa, Acinetobacter baumannii
FDVIMQIRQFQAQRMQAPRDFTPIENTPICVEIGAGKGKHALLFSGQNPQHTLYAIERTREKFLAMQKQHGLEPRDNLVPVHADALPWVVHALYPAQVEHFFILYPNPEPHNPAQRWLNMPFFEFLLSRLKTGGTITLASNIPEYIEEAEQQLLNVWKLPYQKEKIAQTSARTHFEIKYLERGELCQQLIMTKPEGYKTRFDDFAPLQGQVYGE

SEQ ID NO: 8210 - protein, 485 aa, Acinetobacter baumannii
NIAFCFALNLFMNAVVIAIAVMFLLSLARVSVVLTLVVSAIVGGLVAGLSLSQTVEAFNAGLGDGAEVALAYAVLGAFALALSKSGLPDLLAHKLIGLLGMEAGKSRETKVKYLLLGILLIAAIFSQNLIPVHIAFIPVLVPPLLRVMNHLKLDRRAAACVLTLGLVGTYIFLPVGFGAIFLEQILMGNINKIGAAYGLHVERGMMPIGMAIPVLGMVLGTLVAVFISYRKPRIYADRSISPVTTIDLDKPLRATAQDETADLKADAEELKHEAEQGPLIAKKTIFMALLAIGLTLVAQLYSGSMILGGLVGFAVLSTAGIFKWQDADDVFVQGMRMMALVGFIMISAAGFASVMTHTGDINQLVKGVVEIIGDNRALAAFLMLCIGLFVTIGIGSSFSSVPVLAVIYVPLCVQFGFSPLATIALIGTAAALGDAGSPASDSTLGPTAGLGVDGQHDHIWDTVIPTFIHFNIPLLIFGWIAAMVL

SEQ ID NO: 8211 - protein, 303 aa, Acinetobacter baumannii
IGAIFFRAIFEKRCIMQFRKTLNIGIMLKIVLSEIGMTQGLLAGKRFLIAGVASKLSIAYGIAQALHREGAELAFTYPNEKLKKRVDEFAEQFGSKLVFPCDVAVDAEIDNAFAELAKHWDGVDGVVHSIGFAPAHTLDGDFTDVTDRDGFKIAHDISAYSFVAMARAAKPLLQARQGCLLTLTYQGSERVMPNYNVMGMAKASLEAGVRYLASSLGVDGIRVNAISAGPIRTLAASGIKSFRKMLDANEKVAPLKRNVTIEEVGNAALFLCSPWASGITGEILYVDAGFNTVGMSQSMMDDE

SEQ ID NO: 8212 - protein, 110 aa, Acinetobacter baumannii
VAKMDQVNFFKCLSDETRLNIVTLIAENNELCVCDLTEKLQLSQPKISRHLALLRSSGLLQDRRQSQWVYYSINQQLPAWCFEILDTLKKTSSSQVVSNTNTLSINSYCE

SEQ ID NO: 8213 - protein, 274 aa, Acinetobacter baumannii
KVKILITGANTGIGFATAEQLVKQGQHVILACRNPQKALEAQNKLRSLDQGQVDVVSLDLNSLELTQKAAEEIADKYGSLDVLINNAGLFSKTKQLTVDRFEQQFGVNYLGHFLLTQKLLPVLKQSPQARIIHLASIAHWVGSIKPNKFRAEGFYNPLFYYGQSKLANLLFSNALAEQLADSSITNNALHPGGVASDIYRDLPKPVYAAMKVGLVPTSVPAKLITEMATGDTWQNRNGEHVSAHMPDWKSSHAKNQQLARDLYQQSMTLVEKFL

SEQ ID NO: 8214 - protein, 303 aa, Acinetobacter baumannii
YRKIFLFFADNSLSYTALYMKISLSSFQIGSFFALCSAFLFSTKAIFIKQTYALSPLVDGTVLMALRMLSALPFFLLICWFNRHHNQGIKKKDWLILIFAGLLGYYFASWLDFMGLMFISASLERIILFLYPTLTVIASSLLYKQKLDVKSLFAIFLSYGGTVLVMLQEHNNAPIQGNFWLGTSFVFASAVAFAGYLLLTPPLIKKFGSWNFTGLALTVACIGTLTHYVLSTPQPIQLLLQLPSSVIWYGIGLGFLVTVLPTVMLMQSIERLGASQSAMIASIGPVLTILLAVAFLNEHLNIW

SEQ ID NO: 8215 - protein, 379 aa, Acinetobacter baumannii
GVEMMKIPEYVPIMKAKQGEFDAIKPIRSEQLEYQIQPTFHPLFEMPNIYKEGVSRLVDINSRCEKIGKLWSGNIALVDGYFWKPSEALLENGEHFLTYTYNKLFALGVKVVPVIGYDRWFDQMSSLYHQTMKNLNYPEAPYFCIRLDGEAMYDIDEPDFFKEQLESIISDLKLAENNCSILLDFGDVSVNRITIEQMLSKSRDFLEVLTEYDFKYISISGASYPSSVAEAIEDHDTDGPVLRKEMVVWQTLRNMFPNVKLKFADHGARHPAPEKQIINQHTNGKIIYTIDKNYYVVRGHPFSRDGGSHGHRKQLAMRLINSIYYEDVSFSWGDNKIFECAHGINNFIGNPTQWVAIDTSHHIRYVLEEIGSFELAYQK

SEQ ID NO: 8216 - protein, 60 aa, Acinetobacter baumannii
FKVFLHFEALKISKYSHIMILAPIDDSFHQQLINSRLSLRGISSCCHHGLFSCLIFRKNL

SEQ ID NO: 8217 - protein, 202 aa, Acinetobacter baumannii
RMYVPTIENALVPVVVEQSSRGERSFDIYSRLLRERVIFLTGEVEDNMANLIVAQMLFLEAENPDKDIHLYINSPGGSVTAGMAIYDTMQFIKPDVVTYCMGQAASMGAFLLNAGAKGKRYCLENARVMIHQPLGGFRGQASDIEIHAREILFIKERLNRLMAEHSGQDYDTIARDTDRDNFMTAQAAKEYGLVDQVLSKRP

SEQ ID NO: 8218 - protein, 95 aa, Acinetobacter baumannii
NINVTFLSWQPVDIKRTKKRYKIMAGLSIWHVVIFAIVVILLFGTSKLKNIGKDVGGAVRDFKKSVREEDEAASLNSPRTIDAQVKTSESTSVKS

SEQ ID NO: 8219 - protein, 278 aa, Acinetobacter baumannii
RNDVKNVVHSMCKHREQESMCIVALAWHVLDDMPLYLISNRDEFYHRPTALLHQWEHTPIIAGQDLQSGGTWMGVTPQGRWAVLTNFRDGRDKKQYETSRGHLVQAFLESDLLPIRFAQQLEQQQQNFAGFNLFMGTTDQAVYMSNRGEAPQVLANGVYVVSNGLMSDHWEKTRHLRTRFTQEFLPMHQHKTEELSLQHAAWDILEDERKVTTALLPNTGIQPEMEELLSSTFIQSPVYGTRCSNFLRMTNNEWIWLEKTQQGEHSGQIVQQQVLLNR

SEQ ID NO: 8220 - protein, 159 aa, Acinetobacter baumannii
SGCVYHRSRRYHATHFCIRGLSPLEYVWSCTSWGEIIMISLEFLLASAIGLLVATGIYLILRARTFPVVLGLAVLGYAVNLFLFAMGRLQVSSPAILTETTNITDPLPQALVLTAIVIGFATTAFIVQLALRSRYESGSDHVDAKEDISPTYDPREDEP

SEQ ID NO: 8221 - protein, 119 aa, Acinetobacter baumannii
MARVKRGVVAHRRHKKILARAKGYYGARSRVYRVAFQAVIKAGQYAYRDRRQKKRQFRALWIARINAGARQNGLSYSRMIDGLKKAQVIIDRRVLADIAMHDAVAFAALAEKAKGALAA

SEQ ID NO: 8222 - protein, 112 aa, Acinetobacter baumannii
NLFLEQSMKTLFRRSFTAFMCVGTLIAGTQSWAADAQQKNTVSTEVKVNSKAQEKCKKPCDMKDGKENQQNHSQHDHSQMSDMSQMDHSKMMNMDHSQMSEMDHSKMNMPNK

SEQ ID NO: 8223 - protein, 79 aa, Acinetobacter baumannii
MQIVRLQEPQRMGEFNVYGIYVPALLVQAIFAYICFRWLSPLTNKWIAQGWIALPSIFNLCFYLLLLLVIHQIFVGLGA

SEQ ID NO: 8224 - protein, 68 aa, Acinetobacter baumannii
GYCFMPRTFPCPRCGEPSVWEGNEFRPFCSERCKLIDLGAWANDEYRLPTQDAPQQDKGSQHEDDYED

SEQ ID NO: 8225 - protein, 209 aa, Acinetobacter baumannii
IRCLYLMNYFDYFLFIFSVIIMIATPGPVMILVASAGLKGGYKKALETIFGTNLASLVLIFISVLVLKGVLGINENYLNIIRVLGCLYIGYLGFSILKEVIQAPHPEAIQTVFAQNGGFKKGFLVGISNPKDIIFFSAFFPQFVSISPHLDLSLTILTLTWIVLDFLTLSLVYIFFRRLSNSHLYPKILGLCGLLLLVIAVYGLYQTFI

SEQ ID NO: 8226 - protein, 93 aa, Acinetobacter baumannii
FLHVDAGWSSLVARRAHNPKVVGSNPAPATKFLKEAHRQGGPFCTVDYCFLCYIGAINALFYWLSYRYRVVSTSIGQIVMLHYSKSVSVKTTD

SEQ ID NO: 8227 - protein, 171 aa, Acinetobacter baumannii
SMIVIAMGVCGTGKTLIGELLSERLACEFLDGDTLHSAANKSKMSQGIPLTDEDRLPWLQAIRQAIEAKQRDGETAVFTCSSLKRMYRDILRGQDQNVKFVYLKGSYELLQQRLAERSGHFFDPALLQTQLDTLEEPDVNEAIAIDIALTPEQIIEQVIQKLGVTDSVCRG

SEQ ID NO: 8228 - protein, 503 aa, Acinetobacter baumannii
NHSVSNIEKPKATYEQAIAIDNARLGQSFKVIAYAGTGKTTTLQMISDAMPERRGMYLAFNKAIAGEAQNKFHRNVDCRTFHSLAFRSVPRGVTDKLRLPRLSPSFIAKEYRLEPITLRRMMGGRYEKYVLMPSRLASLVANAVSYFCSTSSQYPAPRHIQAPNWLHPDDITALQTHLYPAVERRWLESIDPNHQAGIGHDIYLKLWALSEPNIPADYVLFDEAQDADPLMLGILLRQKSTQVIYVGDAHQQIYAWRGAVNAMQQLPLPESRLTTSFRFGEAIADVANALLGGLNETVPLLGNPNQKSSVVNKPHTKMRDAILCRTNARAMELLLAGLVHGDKVSLQADHQKLNRFVDAASLLKQGKRVTDVPELAWFNSWHDVHEYCETNEGSDIKPLVKLVDDHGTDPLKKALAKITPLEQADYVISTAHKAKGLEWNRVHIEDDYQFKINGLEHKITDEELRLLYVACTRAKVSLNIHHLYDLIQQLKLRAPLSLRQSVG

SEQ ID NO: 8229 - protein, 282 aa, Acinetobacter baumannii
DFKVTDQFFELEGYMDKLLKIMQELREKCPWDQEQTPMSLTKYAIEEAYEVEAAIRQGDINEIRNELGDLLLQVVFQSQMFSEQGAFNFQDVVEAISEKLVRRHPHVFQADQFNNLTPEQVSELWKQIKQQEKQGKTQSRLDEIKHGPTLSQAQEIQKNVAKVGFDFETVEDAYTKLEEELDEFKQALKNQNSNEIQDEFGDCLFSLVNVGRKLGISSESSLLSTIHKFRSRFAFIEEQAIKQQRTLEDMTLSEMDELWNQAKRQLKSGEKPHAIQHKILEK

SEQ ID NO: 8230 - protein, 766 aa, Acinetobacter baumannii
VLKVMSLIRTRKKIVSSAIASSLSMIATTAMAQEAVSQLPTIHTKATQEESLKVDQSANSKFVAPLKDTPKSVSILSQKLIKDTNSNTLLEALRYEPGITLGAGEGGTPFTDMPYIRGYSGQSSIYVDGVRNTTSQNRDMFAIEQVEVIKGSSSALGGGGSVGGSINLIPKVAHEGDVYQGSVQSGTDNYRHIQLDANKDFGNGIAGRVVIMGHENEKAGQSNGAEYKRVGIAPSITFGLDTATRGTLSYYYLRSNDEPDAGIPFNNANPAKPPVGVTVTPGDGKPVDVKAGTYYGWKARDFDKRENHIGTFKLEHDFNENLTLSNIATYNKSKSDYVYTNADDSKGNIYRGTVARRALSRILDTDAYSDQLSLRGKFNTGSLKHSFNVGTEWSFQETDQGVHTFTNAAGETTSTILDSNIQNCTSAAAVANGWCTSLNNPGNGAFTDKRGSITAQSTTRSHNVGIYALDSIEFNPQWLLNLGVRWDKFETEKKYNKDVDGRTPHKAGDKLESDTDYFSYQAGLVFKPTEDGSIYLSYATSANPVGVLAEGDTGSDSISDSGTASASANALKPEEARTFELGTKWDLFNNRANLTAAVFRTEKQNTRIQIDPTTTANAGKSKVDGFEISLNGKITDKWDVSTGYSYIDSEITEAAYNAVAQEGKPLPFVAKNSATLWSTYRVMPQLTLGAGVEYRDQVFVNTTAPKYLPTYTIYNAMAKYDVNKNVNLQLNINNISDKRYFTSAHAAHYAFEGNGRNAVLAINFKY

SEQ ID NO: 8231 - protein, 362 aa, Acinetobacter baumannii
IGEVAMTIISRESLQKSRWMLMLRASDNIYFAPGIPYKKLQGAMSYLPQGIHPDEILMLIDDTVFGSAKAGLCVTATGLFYKESFGDEAVYLFKSIHHVEADIGVINHGIVLNRIETLTFTQLDKGTVRTLASFLNEVCQGETETDRAPPQIDAELKVIIDLFAYFITFNMGKWNPESSHAISKHFVKLNDEASQHYIKRLLTEHPNFEYEELLHRFAELKDVLAYKLRTEMIEQLVYAMALGQVEQNQADLFMTHLCRVSNVSKAVFPDLVKIIYQCLADEMNQSTTSTFNGGQLQACKLLDIQPNSLTEQNLQSAYRKKMAEFHPDKYQNLPESVRQLIESQAQQLNEARALLKSYLDNN

SEQ ID NO: 8232 - protein, 141 aa, Acinetobacter baumannii
IRGVSAPLFYATVFISQERRFAMLEFWFNTQVPTFKKLIILIITLLICIGLYQYQPLPLDTILMFTGTGVIFLICRYFKLHFAQSNPTGLLYRLFTWVPIALLFALIFVKTMPNLLIWGVQGIAFMALAAFIFSPQSLFNK

SEQ ID NO: 8233 - protein, 1125 aa, Acinetobacter baumannii
VCLVCLCESLLGVTPMKRMLINATHAEEVRVALITGNRLYDFDLENRTREQKKSNIYKGHVTRVEPSLEAVFVEYGAGRQGFLSMREIANSYFQADPRQTSNIRELITEGTELLVQVEKEERGNKGAALSTFISLAGRYLVLMPNNPKGGGISRQISGSVREELKEILASLNVPRGMSVIVRTAGIGRTQEELQLDLQHLLDLWAQIQGTASSGPSPMLVHQEAGVVTRAIRDYLRDDVAEILIDSEQAYNEAYNFVKAVMPRQLDKLKTYTLNEPLFAHFGIESQIQTAYEREVKLPSGGSIVIDQTEALVSIDINSAKSTRGHDVEETALNTNLEAAEEIARQLRLRDIGGLVVIDFIDMTKERNQRMVEAKLREATQSDRARIQFGQLSRFGLMEMSRQRLRPSLEEATGYVCPRCHGTGMVRDLRSLSLSIMRKVEEIALRERHGEVQVEVPVEIAAFLLNEKRHSLVYLEQTSGVRVTVLPHPHLETPHYEIAYNPDGFAPSSYERTEATRSSEKELGYESSEWHLEEADHGHAHVTATASTHAAAQKKANHATQPVAQPSAQKAASPCAWLENLFVQKQAQTVDQSRSAQNAAAAIEQMVNTGAVSRGQFGQVAVPAVAEVAPVQSNNAYISQSPVKQDVREHVEKDDKSQQQRQNNKKRKHKEQREQHHQSHEQQHQVHEEVVQLSRQEQRELKRQQKRQQQQDQQHQNNDVQHTENAVPRRDRNNQQRPNRPNRHRDPSVLNENQNTPVVVDEKQIKVDVIDAPKHDVMNTALIINVDQGQSEIVALTPERRHVERVETTSTEVAQEPTPAPVVAEKAAVVETKEEAQPSQEAAQPQIKRASNDPRMRRRQQREAKHAKAATPSIAPSQIPTLAQHTIGSLIRHVYGEDCTVLIEQFGLVPTFNRALQKFAEQYASTLVVEVSAETEEKKPVTRDAELPSHKPAEEAEPAPVLPLTPPQAPAPRVANDPRERRRLAKLAAEQAFEQVKQQHSAQEEVATPAPVAEETVAAPTAETQATVEPAQQPLELNQSTEVVQPEAAPAEEKATEETVAEAPAAKEPAPSKAASKAKAAAEETVAPTEATTDAESEDVKADKDKPSRPRRPRGRPPKKANPVAE

SEQ ID NO: 8234 - protein, 105 aa, Acinetobacter baumannii
GRMVCSGLTQRNEALVMIDTTVDVINKLGLHARASGKLIEVTTKFRSSIQIGKGDHLVDAKNIMSLLMLGAGKGTTLRLVIDGTDEEQALNEVQALFAAKFYEAD

SEQ ID NO: 8235 - protein, 62 aa, Acinetobacter baumannii
TDVVMHLFWSVKVVVGKRIVRIVMRILRYTLSLILTYIATTVAQFIACQTTALSVSKRASKL

SEQ ID NO: 8236 - protein, 134 aa, Acinetobacter baumannii
KVTVFGLRQLKSKAFMQQFLALSVVAPNGTRIAQGIKTLEVRSWVPAQLPLKDLFIVENQNFLKNDGDEEGGVAVALVDVDSIHVWQNDEIEPACATGWSEGYFAWVLSNVRPMKRQLKVPAKRKIYQVSLDLP

SEQ ID NO: 8237 - protein, 437 aa, Acinetobacter baumannii
YFAVHKDCLMKNFKFSLAWQILIALILGIVVGAVLHNQPEIKDSIVNNVLTPLGKIFISLIKMIVIPIVFSTLILGIAGVGSTKSLGRLGFKTILYFEIITTIAILVGLFAANIFHPGSGIDMSQLVQTDISQYKHTTEEVQSQSHGIIQTILSLIPTNIISSMAHGEMLPVIFFAVLFGIGLSSLPATTKDPLLNVFHAVSETMFRVTHIIMKYAPVGVFGLIAVTVANFGFASLIPLGKLVVLVYGAILFFALVVLGITAKMFSINIFTLFKILKDELILAYSTASSETVLPRIMQKMEAYGAPKAISSFVIPTGYSFNLDGSTLYQSIAAIFIAQLYGIEMSISQQVILVVTLMITSKGIAGVPGVSFVVLLATLGSVGIPVEGLAFIAGVDRIMDMARTALNVVGNALAVLVISKWEKQYDYEKAAAYEASLK

SEQ ID NO: 8238 - protein, 190 aa, Acinetobacter baumannii
TPQVGGDFLNTDIGSTGRDFTMIIYDGQVADNYMYQDSNQAAIVVSHSTPSLPYPFTMKPNNHSTETNTPPAIDVEKFVAKLESITSRRSKARCARSIRIALESAGADVENHPIAASDWGDTLKKIGYKEINPAFDEPQEGDIYIIHRTRNHIYGHIAGYTGSEWVSDFKQSSYDVYKDDNVTYTYYRLG

SEQ ID NO: 8239 - protein, 413 aa, Acinetobacter baumannii
TLKVLTMEFKVIRTREQYQAYLDEVHSLIMLNPAIGSPESDRLELLSVLIEDYENKQYPIEAPDPIDAILFRMHEKGLKQADLAPYFGTTSRVSEVLNRKRALTVDMIRALSVGLGLSVETLIGLSNSKNTLDKNNIDWSKFPVKEMKNRGWLKTFLADTAASTESIIQKYIAQSGLQIGSASFKRKLSGDAQTPNTMYALYAWLARVILQARDKKDSLGKYDPNLINSNFLRELAQLSWFEHGPILAIEYLEKHGIAVVIEPHLKGTHLDGAALKDSDGTPIIGLSLRYDRLDNFWFTLLHECAHIWKHVDETEAFLDDLDSSSMEDRREAEANRLAREAFIPRGVLRRTEAFISPSKESIEKLAKELRVHPAIIAGRIRKELGNYTLFSDLVGQYQVKALLTNSHLLSVEE

SEQ ID NO: 8240 - protein, 470 aa, Acinetobacter baumannii
RPLFRQCLDNIIPRRKCHMETVQGGMLLVYTLIAIVALIVMIAKFRIYPFLVLIIVSLGLALAVGMPMDGIVKSYEAGTGKTLGHLAIVIALGTMLGKMMAESGGAERIAITLIKWFGEKHIHWAMMFIALIVGLPVFFEVGFVLLIPIAFNIAKRTGKSLLIVGLPMVAGLSVVHGLIPPHPAALLAVQAYHADIGKTIMYSLLVGVPTAVVAGPLYALWINKYVKLPENNPLAKQFVEADANNTRELPSFGITLFTIMLPVALMLVGSWADVFFAPKTFPNELLRFIGTSDIALLIAVLVSFITFGTMQGFNREQIEKFCGGCLASIAGILLIVGAGGGFGGILRDSGISNEIVSTALKANLSPLLLGWLVAALIRLATGSATVAMATACSIVAPIAAAAGVVVRPELLVLATGSGSLIFSHVNDAGFWLIKEYFGMTVGQTLKTWSVLETIISVLGLSFTLLLSAVL

SEQ ID NO: 8241 - protein, 1009 aa, Acinetobacter baumannii
LYLFKNKDMSTRLIQHLKNKCEADDNVAILYAQWEFDQKLVGKALENIGGFYPHFSNHNASHSQQILVNIERILGNDIELLSATDTWLILEAAYWHDVGMLVDAKNAKEVHTNPDFNFMIQTIANEKGHDLQKFCQAYVEQNWLSAIGIVDHPFDGIEQYRQLVAEWFRRRHDKRVGKIVEDPFKDLGITSSRTELLPNRIYRYLGQICVSHGMNFDTLMETLPYKQTGLGTEDCHPRFIGCLLRLGDLFDLDDNRFCPVMAKHVSNMPSVSKHHHDKHLSLREFQLDKRTVKLVAECPDEMSYVETQNWFGWIRQEFQNQMSQWNFIVPSLEFGSLPTIEQLDVRMQGNKILLSNKPMKFTIDENNALEILEGSGLYKNDTNIFRELIQNAIDATLIQVWCDFEKGRIKLPKNPHPFDNKVQNILKSYALEISFERIGIIDGSDDAWWEFKIEDKGTGISLLDLNYMQKVAGSSRNIERQKIINRMPIWMRPSGQFGIGLHSAFLLLKDINEEDQKITIISTNSVDYKTYKIELNSPLKSKKGYCFIEEQKEIKKDIGTTLILRLKKKRRARSYSYNNSELYKFLYTKHDPLKEEMFDVFNIATQVENIKDEVLRNICLPYEFNEEWQVKINSVFPQQKNTFDNIIWVDKYSLYLIVDEIKISNLNELHSRLDGGFKGQNVGRISYYNQIFGFYLMFFGLEAKSTLQTNRNEWSKDFERKFIEHRFLHELCRHILDEYKDQLIDILKDSKIIDLFDFCFNEDKSKISWKEIQMFNVDKWPNYKHKNKKCKIYNKSFKELLSLKKFNFYYIDEFINPNFDISNLSTNDLVYPAPFNSWFKDYFDQDWIDKGGFVSTEKIKGGGEIVRYSTEKTHEIESGDFRIVNQIKFAIQQDRKRINFNQEWMSKIFFREFKALFTKSILVERLVGLENLNVKHLILPFYIFSKDLEAGPNIRIDYLEDNELVRSTWDSRDEEFEDLKFEDFLTLYKKLEEKISKLINTIYPNWIQK

SEQ ID NO: 8242 - protein, 466 aa, Acinetobacter baumannii
VHSLKQQAKSRKPQQPEYIFQVETLSHEGRGIAHYGSHPDHPADKHGKKVFIRYALPGETVKAQITHEAKRLEEAEMVELLAEPSANRVEAVCPHYGICGGCSMQHIHPDEQIHLKQNVLQSHLQHFAGIQPEQWLEPIRSLQSDYRRRARIGVRYLPKQDRLILGFREHHSNRLTSIHTCSVLDKKLSDNLPELRNLLQSLKGKAHIGHVELAKGDHEISLLVRHIEKLNNADVNQLRQFALHKGWQLYLQPKGPESLRRIDEEQGAMRLHYALNAFDVNFAFSPLDFTQVNATVNEQMVQLACELLQLQQGERVLDLFCGLGNFSLPLARCVGAKGQVVGVEASEEMVQRATDNAKRNNLVQASFFSQDLTKDFSHHSWANQGFDALLIDPPRAGAYEIMQYVPNFGAKRIVYVSCNPATLARDAGVLVQHGYQLKKAAVMDMFTHTEHVESIALFEKIQEIND

SEQ ID NO: 8243 - protein, 178 aa, Acinetobacter baumannii
LQVLMRGSSMHLAQRLAAVVLTLGLSAGLVGCGFHLKGTNPTATPLVYKKLSLELPAKTDDLETQLKVYLTANGVQLSNDNDAYVLRVLEYTPRRQLLNGKLTEVLLRLTVTFQIEDRQGNKITEPRTLTAARSYQYDLATVNTENQQESYLQRIVIDDLAQQITRQISANRLPKAQP

SEQ ID NO: 8244 - protein, 637 aa, Acinetobacter baumannii
NISFGLFLCSGLSGCTGASSMDLPNPVLAKVTERVIARSQKTRSTYLQRIEHAQGKFPARGALSCANLAHGFAGMEDNEKLIIKVGREPNIGIVSSYNEMLSAHAPYKTFPDIIKTAARENGGVAQFAGGVPAMCDGITQGNAGMELSLFSRETIAMGTAIALSHNMFDAALCLGVCDKIVPGLLIGALQFGYLPTIFVPAGPMSSGLSNDDKAKIRQQFATGQVGRDALLEAESAAYHGQGTCTFYGTANSNQMLMEVMGLHLPSAAFVHPHTPLRDALTAEAAKRVLDLTAERGNYTPIGHVIDEKAIINGIVALLATGGSTNHTLHLIAIARAAGILIDWDDFDELSAVVPLLAKIYPNGKADVNHFQAAGGVAFLIRNLLEAGLLHNDVTTVAGKGLQHYTKEPKLIDGKLTWVDGVVQSLDDKVLRSIDAPFQPDGGLRLMQGRLGRGVIKISAVAPEHRKVKAPAIVFDSQEAVQAAFDRGELHRDFIAVVRFQGARANGMPELHRLTPVLGVLQDQGFHVALVTDGRMSGASGKVPAVIHLSPEALLNGPIGKVQTGDMLIIDAEAGVLDIELDEQTWQSRPVAQPEHQAENEVGFGRELFGVFRAAAAPAEHGASVFGALVGEEPQGQI

SEQ ID NO: 8245 - protein, 65 aa, Acinetobacter baumannii
LISFNLFYLSPFDIRSNGFFYFLKNKPDSRLFLILNNLAFVLFDFRSKDQPIPHKIVFLSYNLAR

SEQ ID NO: 8246 - protein, 137 aa, Acinetobacter baumannii
TESLMAGGQRLKRMADSVQRELSELIRQELKDPRLGGLVTISGVKVSPDLGYADVYVTVMGRELSDDQNEVAHRETLDILNKASGFLRQELSRRIKTRITPRLRFHYDKTNAYGNYMFGLIEKAVQDLPKRESDDEE

SEQ ID NO: 8247 - protein, 274 aa, Acinetobacter baumannii
KSALNRGEAMQRYAVGIEFSGIQYRGWQTQQPGVASVQETIERVLSKIANEPITLHGAGRTDAGVHATNMVAHFDTNAVRPERGWIMGANSQLPKDISIQWIKQMDEEFHARFKATARRYRYVVYNAPHRPALLHKQVTHIYQKLDVQKMIKAASKFEGTHNFETFRAAACQSNQPVRHVKHCRLFEHGRYLVLDIQADGFLHHMVRNIMGCLLEIGQGMYEIDHIDAMFAAEDRKAAGITAPPDGLYFIQCYYPEQFDLPQPPLGPHWLNLPE

SEQ ID NO: 8248 - protein, 114 aa, Acinetobacter baumannii
MKAFLVLDELNQFHWAMLKSVLLILALLPIAEVSLKLWLSTEGSSQIMIGFFALSIVSAWLMVSFFTALKTSVWQTKQMASKYEQLLFKAYRYVPMVFLSSLVAYLSLQLSIAF

SEQ ID NO: 8249 - protein, 235 aa, Acinetobacter baumannii
DIFSNKIYKNNYVIPISIIIFKDISMLDLSQILAFGLICLAMVLTPGPNMIYLISRSISQGKIAGFISLGGVAVGFVFYMLCASFGITALVVAVPYAYDTIRIAGAMYLLWLAWKALRPNAAPIFNVKDLAVDSPLKLFLMGFLTNLLNPKIAIMYLSLLPQFIHPQQGSILAQSIQLGTIQIFVSVSVNALIVFSAGSIALFLQKKPLWASIQRWVMGTVLAGLAVRILLEHRR

SEQ ID NO: 8250 - protein, 158 aa, Acinetobacter baumannii
IMKFLFLCTGNSCRSILSEVLFNSRAPHDWKAYSAGSKPSGQVHPLTIETLENLGLSTEGLWSKTIDDCEQYKPDVVITVCDSAAQEACPLYLGGAIKAHWGLADPSHLDLPKEEKLKAFLVTVDHINRRLDALFALDTANMSRPELIAAINHISDIE

SEQ ID NO: 8251 - protein, 239 aa, Acinetobacter baumannii
PYELTKVIKMSLPKALKTKDRILQISLQLFNERGERSVTTNHIAAELGISPGNLYYHFRNKHEIIKELMHQYQVETLEMLSLPEDRPLTTNDKINYFQVLSGQLWNYRFIHRDVYHLVESNEDFKKIYPRFAGQVMQQGQRIYQAFVDAGLMKMTPSEIEALIINLWIVLTNWTNFLYMSGHISDNNHLEEKWVWQALRQMVFLEGPYLMGESRATYEQLLESLGPSDLFASLSSLKDE

SEQ ID NO: 8252 - protein, 654 aa, Acinetobacter baumannii
NAPSYRASLLKDFFMPIITLPNGDQKSFDHPVSVMEVAQSIGPGLAKNTVAGRVNDRLVDACDLITEDSTLQIITPKDEEGLEIIRHSCAHLVGHAVKQLFPEAKMVIGPVIEEGFYYDIWMPRPFTLDDMAAIEERMKKLIDQDYEVIKKMTPRDEVIKVFTDRGEEYKLRLVEDMPEEKAMGLYYHQEYVDMCRGPHVPNTKFLKSFKLTKISGAYWRGDAKNEQLQRIYGTAWADKKQLAAYIKRIEEAEKRDHRKIGKALDLFHMQEEAPGMVFWHANGWTIYQVLEQYMRKVQQDNGYQEIKTPQIVDFTLWEKSGHAANYAENMFTTHSESRNYAVKPMNCPCHVQVFNQGLKSYRDLPIRLAEFGSCHRNEPSGSLHGIMRVRGFTQDDAHIFCTKEQIGKEVADFIKLTLDVYKDFGFEEVQMKLSTRPEKRVGDDALWDLAEKSLADALDAAGLEWELQPGEGAFYGPKIEFSLKDCLGRVWQCGTIQCDFNLPVRLDASYVTEENERDQPVMLHRAILGSFERFIGILIEHYAGFMPPWLSPVQACVMNITDSQAEASEQVVAKLKENGLRAISDLRNEKIGFKIRERTLERIPYLLVLGDRKVEEGTVNVRTRSGKNLGTMSVDAFIDLVKSAVAERGRYIVE
